US012583941B2

(12) United States Patent
Kley et al.

(10) Patent No.: US 12,583,941 B2
(45) Date of Patent: Mar. 24, 2026

(54) FIBROBLAST ACTIVATION PROTEIN BINDING AGENTS AND USE THEREOF

(71) Applicants:Orionis Biosciences, Inc., Waltham, MA (US); Orionis Biosciences BV, Zwijnaarde (BE)

(72) Inventors: Nikolai Kley, Waltham, MA (US); Erik Depla, Zwijnaarde (BE); Lennart Zabeau, Zwijnaarde (BE)

(73) Assignees: Orionis Biosciences, Inc., Waltham, MA (US); Orionis Biosciences BV, Zwijnaarde (BE)

( * ) Notice: Subject to any disclaimer, the term of this patent is extended or adjusted under 35 U.S.C. 154(b) by 1203 days.

(21) Appl. No.: 17/442,771

(22) PCT Filed: Mar. 27, 2020

(86) PCT No.: PCT/US2020/025427
§ 371 (c)(1),
(2) Date: Sep. 24, 2021

(87) PCT Pub. No.: WO2020/198665
PCT Pub. Date: Oct. 1, 2020

(65) Prior Publication Data
US 2022/0332844 A1      Oct. 20, 2022

Related U.S. Application Data

(60) Provisional application No. 62/825,575, filed on Mar. 28, 2019.

(51) Int. Cl.
| | |
|---|---|
| *C07K 16/40* | (2006.01) |
| *A61K 38/00* | (2006.01) |
| *C07K 14/525* | (2006.01) |
| *C07K 14/56* | (2006.01) |
| *C07K 14/565* | (2006.01) |

(52) U.S. Cl.
CPC ............ *C07K 16/40* (2013.01); *C07K 14/525* (2013.01); *C07K 14/56* (2013.01); *C07K 14/565* (2013.01); *A61K 38/00* (2013.01); *C07K 2317/24* (2013.01); *C07K 2317/565* (2013.01); *C07K 2317/569* (2013.01); *C07K 2317/92* (2013.01); *C07K 2319/02* (2013.01)

(58) Field of Classification Search
None
See application file for complete search history.

(56) References Cited

U.S. PATENT DOCUMENTS

| | | | |
|---|---|---|---|
| 3,536,809 | A | 10/1970 | Applezweig |
| 3,598,123 | A | 8/1971 | Zaffaroni |
| 3,845,770 | A | 11/1974 | Theeuwes et al. |
| 3,916,899 | A | 11/1975 | Theeuwes et al. |
| 4,008,719 | A | 2/1977 | Theeuwes et al. |
| 4,537,776 | A | 8/1985 | Cooper |
| 5,059,595 | A | 10/1991 | Le Grazie |
| 5,073,543 | A | 12/1991 | Marshall et al. |
| 5,120,548 | A | 6/1992 | McClelland et al. |
| 5,354,556 | A | 10/1994 | Sparks et al. |
| 5,475,096 | A | 12/1995 | Gold et al. |
| 5,591,767 | A | 1/1997 | Mohr et al. |
| 5,639,476 | A | 6/1997 | Oshlack et al. |
| 5,674,533 | A | 10/1997 | Santus et al. |
| 5,733,556 | A | 3/1998 | Schrier et al. |
| 5,831,012 | A | 11/1998 | Nilsson et al. |
| 6,004,746 | A | 12/1999 | Brent et al. |
| 6,433,157 | B1 | 8/2002 | Shanafelt et al. |
| 6,653,104 | B2 | 11/2003 | Goldenberg |
| 6,794,144 | B1 | 9/2004 | Saksela et al. |
| 6,818,418 | B1 | 11/2004 | Lipovsek et al. |
| 6,994,982 | B1 | 2/2006 | Watt et al. |
| 7,166,697 | B1 | 1/2007 | Galanis et al. |
| 7,186,524 | B2 | 3/2007 | Kolmar et al. |
| 7,250,297 | B1 | 7/2007 | Berte et al. |
| 7,399,869 | B2 | 7/2008 | Cohen et al. |
| 7,417,130 | B2 | 8/2008 | Stumpp et al. |
| 7,803,907 | B2 | 9/2010 | Stemmer et al. |
| 7,838,629 | B2 | 11/2010 | Fiedler et al. |
| 7,993,636 | B2 | 8/2011 | Mayumi et al. |
| 8,008,449 | B2 | 8/2011 | Korman et al. |
| 8,217,149 | B2 | 7/2012 | Irving et al. |
| 8,278,036 | B2 | 10/2012 | Kariko et al. |

(Continued)

FOREIGN PATENT DOCUMENTS

| | | |
|---|---|---|
| CN | 106928363 A | 9/2020 |
| EP | 294703 A2 | 12/1998 |

(Continued)

OTHER PUBLICATIONS

Vajdos et al. (J Mol Biol. Jul. 5, 2002;320(2):415-28) (Year: 2002).*
Brown et al. (J Immunol. May 1996;156(9):3285-91) (Year: 1996).*
Vattekatte, (PeerJ. Mar. 6, 2020:8:e8408. doi: 10.7717/peerj.8408. eCollection 2020.) (Year: 2020).*
Edwards et al. (Mol Biol. Nov. 14, 2003;334(1):103-18) (Year: 2003).*
Lloyd et al. (Protein Eng Des Sel. Mar. 2009;22(3):159-68. Epub Oct. 29, 2008.) (Year: 2009).*
Goel et al. (J Immunol. Dec. 15, 2004;173(12):7358-67) (Year: 2004).*
Khan et al. (J Immunol (2014) 192 (11): 5398-5405) (Year: 2014).*
Poosarla et al. (Biotechnol Bioeng. Jun. 2017 ; 114(6): 1331-1342) (Year: 2017).*

(Continued)

*Primary Examiner* — Brian Gangle
*Assistant Examiner* — Andrea K Mccollum
(74) *Attorney, Agent, or Firm* — Morgan, Lewis & Bockius LLP

(57) ABSTRACT

The present invention relates, in part, to agents, chimeric proteins and protein complexes that bind fibroblast activation protein (FAP) and their use as diagnostic and therapeutic agents. The present invention further relates to pharmaceutical compositions comprising the FAP binding agents, chimeric proteins and protein complexes and their use in the treatment of various diseases.

17 Claims, 44 Drawing Sheets

Specification includes a Sequence Listing.

(56) References Cited

U.S. PATENT DOCUMENTS

| 8,354,509 B2 | 1/2013 | Carven et al. |
|---|---|---|
| 8,568,727 B2 | 10/2013 | Adolf et al. |
| 8,779,108 B2 | 7/2014 | Queva et al. |
| 8,907,053 B2 | 12/2014 | Sasikumar et al. |
| 8,907,065 B2 | 12/2014 | Hermans et al. |
| 9,067,991 B2 | 6/2015 | Beirnaert |
| 9,078,860 B2 | 7/2015 | Szkudlinski et al. |
| 9,492,562 B2 | 11/2016 | Tavernier et al. |
| 9,732,135 B2 | 8/2017 | Tavernier et al. |
| 9,878,014 B2 | 1/2018 | Tavernier et al. |
| 9,914,759 B2 | 3/2018 | Tavernier et al. |
| 9,932,409 B2 | 4/2018 | Tavernier et al. |
| 10,034,919 B2 | 7/2018 | Tavernier et al. |
| 10,035,835 B2 | 7/2018 | Tavernier et al. |
| 10,072,059 B2 | 9/2018 | Tavernier et al. |
| 10,407,480 B2 | 9/2019 | Tavernier et al. |
| 10,640,542 B2 | 5/2020 | Tavernier et al. |
| 10,787,493 B2 | 9/2020 | Tavernier et al. |
| 10,906,985 B2 | 2/2021 | Kley et al. |
| 10,946,070 B2 | 3/2021 | Tavernier et al. |
| 10,947,288 B2 | 3/2021 | Tavernier et al. |
| 10,988,538 B2 | 4/2021 | Kley et al. |
| 11,001,631 B2 | 5/2021 | Tavernier et al. |
| 11,084,859 B2 | 8/2021 | Kley et al. |
| 11,236,141 B2 | 2/2022 | Kley et al. |
| 11,236,166 B2 | 2/2022 | Kley et al. |
| 11,246,911 B2 | 2/2022 | Tavernier et al. |
| 11,248,057 B2 | 2/2022 | Tavernier et al. |
| 11,358,997 B2 | 6/2022 | Tavernier et al. |
| 11,384,154 B2 | 7/2022 | Kley |
| 2004/0023334 A1 | 2/2004 | Prior |
| 2004/0132094 A1 | 7/2004 | Etzerodt et al. |
| 2004/0146938 A1 | 7/2004 | Nguyen et al. |
| 2004/0157209 A1 | 8/2004 | Yilmaz et al. |
| 2004/0209243 A1 | 10/2004 | Nixon et al. |
| 2008/0025980 A1 | 1/2008 | Hardy et al. |
| 2009/0101611 A1 | 4/2009 | Lin et al. |
| 2010/0119446 A1 | 5/2010 | Grabulovski et al. |
| 2010/0239633 A1 | 9/2010 | Strome et al. |
| 2011/0262348 A1 | 10/2011 | Movahedi et al. |
| 2011/0271358 A1 | 11/2011 | Freeman et al. |
| 2011/0318373 A1 | 12/2011 | Sasikumar et al. |
| 2012/0039906 A1 | 2/2012 | Olive |
| 2012/0244112 A1 | 9/2012 | Ast et al. |
| 2012/0258119 A1 | 10/2012 | Renner et al. |
| 2013/0058962 A1 | 3/2013 | Shoemaker et al. |
| 2013/0309250 A1 | 11/2013 | Cogswell et al. |
| 2014/0044738 A1 | 2/2014 | Langermann et al. |
| 2014/0271462 A1 | 9/2014 | Ho et al. |
| 2014/0356353 A1 | 12/2014 | Queva et al. |
| 2015/0011732 A1 | 1/2015 | Pepinsky et al. |
| 2016/0145325 A1 | 5/2016 | Verheesen et al. |
| 2017/0368169 A1 | 12/2017 | Loew et al. |
| 2017/0369592 A1* | 12/2017 | Brokopp .................. A61P 7/02 |
| 2018/0002445 A1 | 1/2018 | Bauer et al. |
| 2018/0022822 A1 | 1/2018 | Brokopp et al. |
| 2018/0030120 A1 | 2/2018 | Riazi et al. |
| 2019/0144553 A1 | 5/2019 | Kley et al. |
| 2020/0231674 A1 | 7/2020 | Kley et al. |
| 2020/0308244 A1 | 10/2020 | Kley et al. |
| 2020/0354424 A1 | 11/2020 | Kley et al. |
| 2020/0407448 A1 | 12/2020 | Kley et al. |
| 2021/0024631 A1 | 1/2021 | Kley et al. |
| 2021/0024637 A1 | 1/2021 | Kley et al. |
| 2021/0238264 A1 | 8/2021 | Kley et al. |
| 2022/0026439 A1 | 1/2022 | Kley et al. |
| 2022/0119472 A1 | 4/2022 | Kley et al. |
| 2022/0119519 A1 | 4/2022 | Kley et al. |
| 2022/0153801 A1 | 5/2022 | Kley et al. |
| 2022/0177550 A1 | 6/2022 | Kley et al. |
| 2022/0185857 A1 | 6/2022 | Kley et al. |

FOREIGN PATENT DOCUMENTS

| EP | 2492355 A1 | 8/2012 | | |
|---|---|---|---|---|
| WO | 9404678 A1 | 3/1994 | | |
| WO | 96/34103 A1 | 10/1996 | | |
| WO | 1997/10338 A1 | 3/1997 | | |
| WO | 9937681 A2 | 7/1999 | | |
| WO | 2000/023114 A2 | 4/2000 | | |
| WO | 0043507 A1 | 7/2000 | | |
| WO | 0190190 A2 | 11/2001 | | |
| WO | 2002/018422 A1 | 3/2002 | | |
| WO | 02/085945 A2 | 10/2002 | | |
| WO | 03025020 A1 | 3/2003 | | |
| WO | 03035694 A2 | 5/2003 | | |
| WO | 2004/041862 A2 | 5/2004 | | |
| WO | 04049794 A2 | 6/2004 | | |
| WO | 2004060965 A2 | 7/2004 | | |
| WO | 2006/121168 A1 | 11/2006 | | |
| WO | 2007/005874 A2 | 1/2007 | | |
| WO | 2008/071447 A2 | 6/2008 | | |
| WO | 2008/124086 A2 | 10/2008 | | |
| WO | 2009/114335 A2 | 9/2009 | | |
| WO | 2010/027827 A2 | 3/2010 | | |
| WO | 2010/030671 A1 | 3/2010 | | |
| WO | 2010/036959 A2 | 4/2010 | | |
| WO | 2011/066342 A2 | 6/2011 | | |
| WO | 2011/066389 A1 | 6/2011 | | |
| WO | 2012/145493 A1 | 10/2012 | | |
| WO | 2012146628 A1 | 11/2012 | | |
| WO | 2013059885 A2 | 5/2013 | | |
| WO | 2013/107791 A1 | 7/2013 | | |
| WO | 2015/007520 A1 | 1/2015 | | |
| WO | 2015/007536 A2 | 1/2015 | | |
| WO | 2015/007542 A1 | 1/2015 | | |
| WO | 2015/007903 A1 | 1/2015 | | |
| WO | 2015/112900 A1 | 7/2015 | | |
| WO | 2016/06272 A1 | 1/2016 | | |
| WO | 2016/022630 A1 | 2/2016 | | |
| WO | 2016/025385 A1 | 2/2016 | | |
| WO | 2016030350 A1 | 3/2016 | | |
| WO | 2016/061142 A1 | 4/2016 | | |
| WO | 2016/110598 A1 | 7/2016 | | |
| WO | 2016/113555 A1 | 7/2016 | | |
| WO | 2016/113557 A1 | 7/2016 | | |
| WO | 2017153402 A1 | 9/2017 | | |
| WO | 2017194783 A1 | 11/2017 | | |
| WO | WO-2018228442 A1 * | 12/2018 | .............. | A61P 35/00 |
| WO | 2020/198665 A1 | 10/2020 | | |
| WO | 2020/257412 A1 | 12/2020 | | |

OTHER PUBLICATIONS

Rabia, et al. (Biochem Eng J. Sep. 15, 2018:137:365-374. Epub Jun. 5, 2018) (Year: 2018).*
Skolnick et al.(Trends Biotechnol. Jan. 2000;18(1):34-9) (Year: 2000).*
Burgess et al. (J. Cell Biol. 111:2129-2138, 1990) (Year: 1990).*
Lazar et al. (Mol. Cell. Biol., 8:1247-1252, 1988) (Year: 1988).*
Miosge (Proc Natl Acad Sci U S A. Sep. 15, 2015;112(37):E5189-98) (Year: 2015).*
Bork (Genome Research, 2000, 10:398-400) (Year: 2000).*
Kulmanov et al.(Bioinformatics, 34(4), 2018, 660-668) (Year: 2018).*
Guido et al.(Curr Med Chem. 2008; 15(1):37-46) (Year: 2008).*
Clark et al.(J. Med. Chem., 2014, 57 (12), pp. 5023-5038) (Year: 2014).*
Aagaard et al.(Advanced Drug Delivery Reviews 59 (2007) 75-86) (Year: 2007).*
Warzocha et al.(Leukemia and Lymphoma (1997) vol. 24. pp. 267-281) (Year: 1997).*
Mckeague et al.(J Nucleic Acids. 2012;2012:748913. Epub Oct. 24, 2012) (Year: 2012).*
Fuming Zi et al., "Fibroblast activation protein a in tumor microenvironment: Recent progression and implications (Review)", Molecular Medicine Reports 11: 3203-3211, 2015.
Spangler J. B. et al., Insights into cytokine-receptor interactions from cytokine engineering. Annu Rev Immunol, Dec. 10, 2014, vol. 33, pp. 139-167.

(56)                    References Cited

OTHER PUBLICATIONS

Scanlin et al., Proc. Natl. Acad. Sci. USA 91 (1994), 5657-5661.
Sun et al., Protein Expr. Purif. 24 (2002), 274-281.
Rettig et al., Proc. Natl. Acad. Sci. USA 85 (1988), 3110-31 14.
Garin-Chesa et al, Proc. Natl. Acad. Sci. USA 87 (1990), 7235-7239.
Jin et al., Anticancer Res. 23 (2003), 3195-3198 (Abstract only).
Elliott, et al., (1997) Blood, 89:493-502.
Taylor et al., (2010) PEDS, 23(4): 251-260.
Mathew et al., (2009) Cancer Sci 100(8): 1359-65.
Hamid, et al. (2013) New England Journal of Medicine 369 (2): 134-44.
Strohl, BioDrugs (2015) 29:215-239.
Chapman, Advanced Drug Delivery Reviews, 54, 531-545 (2002).
Veronese and Harris, Adv. Drug Deliv. Rev. 54, 453-456 (2003).
Harris and Chess, Nat. Rev. Drug. Discov., 2, (2003); 214-221.
Yang et al., Protein Engineering, 16, 10, 761-770 (2003).
Cao and Suresh, Journal of Drug Targeting, 8, 4, 257 (2000).
Chichili et al., (2013), Protein Sci. 22(2):153-167.
Chen et al., (2013), Adv Drug Deliv Rev. 65(10): 1357-1369.
Crasto et al., (2000), Protein Eng. 13(5):309-312.
Berge, et al. Journal of Pharmaceutical Science, 66, 2-19 (1977).

Langer, 1990, Science 249:1527-1533.
Nicolaou, et al. Agnew, Chem. Intl. Ed. Engl., 33: 183-186 (1994).
Youle, et al., Proc. Nat'l Acad. Sci. USA 77:5483 (1980).
Gilliland, et al., Proc. Nat'l Acad. Sci. USA 77:4539 (1980).
Krolick, et al., Proc. Nat'l Acad. Sci. USA 77:5419 (1980).
Brennen et al., "Rationale Behind Targeting Fibroblast Activation Protein-Expressing Carcinoma-Associated Fibroblasts as a Novel Chemotherapeutic Strategy", Molecular Cancer Therapeutics, vol. 11, No. 2, pp. 257-266, Feb. 2012.
International Search Report & Written Opinion, PCT Application No. PCT/US19/16629, dated Jun. 11, 2019, 17 pages.
International Search Report & Written Opinion, PCT Application No. PCT/US2020/025427, dated Aug. 14, 2020, 15 pages.
Schmidt, et al., "Generation of human high-affinity antibodies specific for the fibroblast activation protein by guided selection," Eur. J. Biochem., vol. 268, No. 6, pp. 1730-1738, 2001.
Blattler, et al., "New heterobifunctional protein crosslinking reagent that forms an acid-labile link," Biochemistry (1985) 24(6): 1517-1524.
Stagg, et al., "Immunotherapeutic approaches in triple-negative breast cancer: latest research and clinical prospects," Ther Adv Med Oncol, (2013) 5(3): 169-181.

* cited by examiner

*3PE12-AFN*

*3PE42-AFN*

Fig. 22A
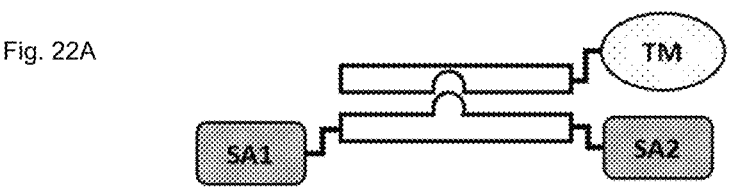
Fig. 22B
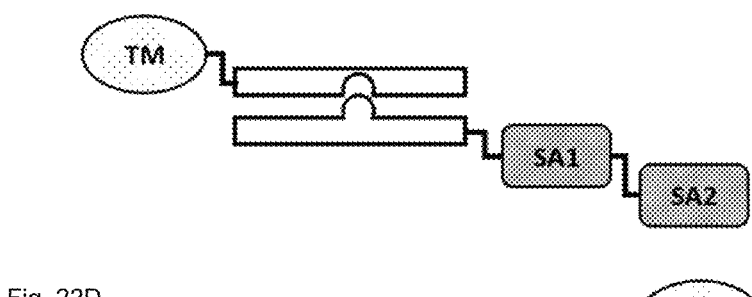
Fig. 22C
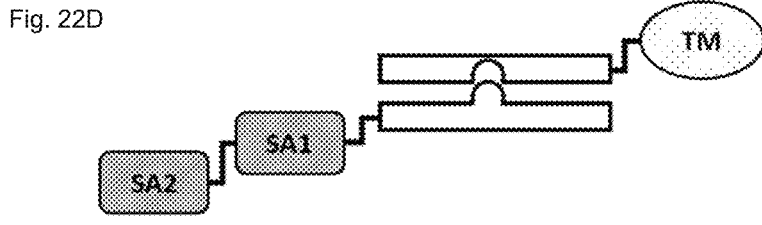
Fig. 22D
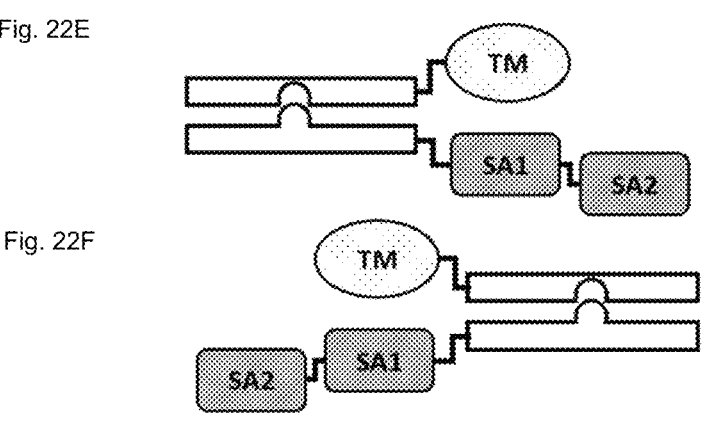
Fig. 22E
Fig. 22F Fig. 23A
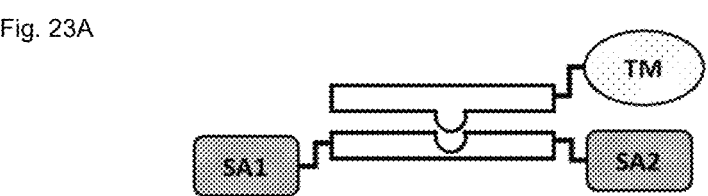
Fig. 23B
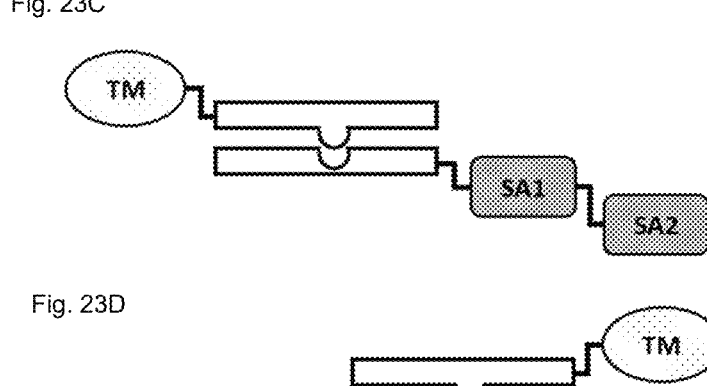
Fig. 23C
Fig. 23D
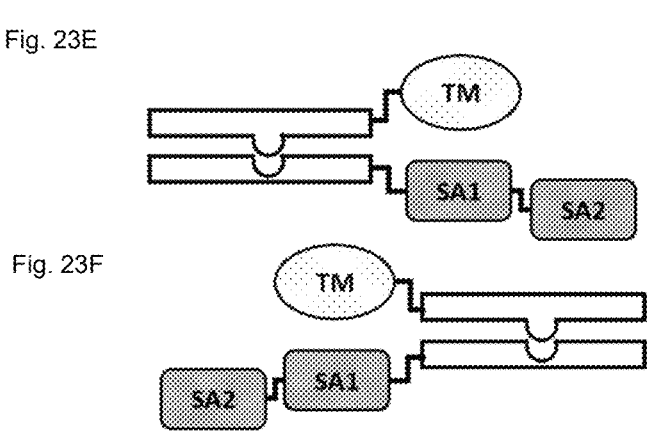
Fig. 23E
Fig. 23F

FIBROBLAST ACTIVATION PROTEIN BINDING AGENTS AND USE THEREOF

CROSS-REFERENCE TO RELATED APPLICATIONS

This application is a National stage entry of International Application No. PCT/US20/25427, filed Mar. 27, 2020, which claims the benefit of and priority to U.S. Provisional Patent Application No. 62/825,575, filed Mar. 28, 2019, the contents of which are hereby incorporated by reference in their entirety.

FIELD

The present technology relates, in part, to binding agents, chimeric proteins, and Fc-based chimeric protein complexes, which bind fibroblast activation protein (FAP) and their use as therapeutic and diagnostic agents.

DESCRIPTION OF THE TEXT FILE SUBMITTED ELECTRONICALLY

The contents of the text file submitted electronically herewith are incorporated herein by reference in their entirety. A computer readable format copy of the Sequence Listing (Filename: ORN-059_ST25.txt; Date created: Oct. 28, 2025; File size: 766,480 bytes).

BACKGROUND

Fibroblasts regulate the structure and function of healthy tissues, participate transiently in tissue repair after acute inflammation, and assume an aberrant stimulatory role during chronic inflammatory states including cancer. Cancer-associated fibroblasts (CAFs) modulate the tumor microenvironment and influence the behavior of neoplastic cells in either a tumor-promoting or tumor-inhibiting manner. Understanding a tumor's microenvironment is important for the treatment of cancer. Fibroblasts express a diverse array of immunomodulating factors such as cytokines, lipid mediators and growth factors. Moreover, fibroblasts display numerous surface and intracellular receptors and the requisite molecular machinery to respond to extrinsic signals. Fibroblasts can be considered extensions of the 'professional' immune system in view of the fact that fibroblasts can initiate inflammation. Fibroblasts participate in numerous normal and pathological processes. Illustrative diseases that aberrant fibroblasts are known to be associated with include cancer, cardiovascular disease, and autoimmune disease. CAFs are prominent stromal components and play important roles in modulating the tumor microenvironment and influencing the behavior of tumor cells primarily by releasing proteolytic enzymes, growth factors, and cytokines. Studies have shown that the cancer-promoting and therapy-resisting properties of the stroma can be attributed to the activity of fibroblasts.

Human Fibroblast Activation Protein (FAP; GenBank Accession Number AAC51668; NCBI Reference Sequence: NM 004460.3), also known as Seprase, is a 170 kDa integral membrane serine peptidase (EC 3.4.21.B28). FAP belongs to the dipeptidyl peptidase IV family and is a homodimer containing two N-glycosylated subunits with a large C-terminal extracellular domain, in which the enzyme's catalytic domain is located (Scanlan et al., Proc. Natl. Acad. Sci. USA 91 (1994), 5657-5661). FAP, in its glycosylated form, has both post-prolyl dipeptidyl peptidase and gelatinase activities (Sun et al., Protein Expr. Purif. 24 (2002), 274-281). Thus, FAP is a serine protease with both dipeptidyl peptidase, as well as endopeptidase activity cleaving gelatin and type I collagen.

FAP has a unique tissue distribution: its expression was found to be highly upregulated on reactive stromal fibroblasts of more than 90% of all primary and metastatic epithelial tumors, including lung, colorectal, bladder, ovarian and breast carcinomas, while it is generally absent from normal adult tissues (Rettig et al., Proc. Natl. Acad. Sci. USA 85 (1988), 3110-31 14; Garin-Chesa et al, Proc. Natl. Acad. Sci. USA 87 (1990), 7235-7239). Subsequent reports showed that FAP is not only expressed in stromal fibroblasts but also in some types of malignant cells of epithelial origin, and that FAP expression directly correlates with the malignant phenotype (Jin et al., Anticancer Res. 23 (2003), 3195-3198).

Due to its expression in many common cancers and its restricted expression in normal tissues, FAP is a promising antigenic target for imaging, diagnosis and therapy of a variety of carcinomas. There remains a need for improved therapies for treating diseases associated with aberrant fibroblasts, e.g., treating cancer by modifying CAF functions or fibrotic diseases.

SUMMARY

In one aspect, the present technology relates to a fibroblast activation protein (FAP) binding agent that targets or binds to FAP. In some embodiments, the FAP binding agent comprises a FAP targeting moiety. The FAP binding agent or the FAP targeting moiety can be, e.g., a full-length antibody, a single-domain antibody, a recombinant heavy-chain-only antibody (VHH), a single-chain antibody (scFv), a shark heavy-chain-only antibody (VNAR), a microprotein, a darpin, an anticalin, an adnectin, an aptamer, a Fv, a Fab, a Fab', a F(ab')$_2$, a peptide mimetic molecule, a natural ligand for a receptor, or a synthetic molecule. In some embodiments, the FAP targeting moiety is a single domain antibody (VHH). In some embodiments, the FAP binding agent directly or indirectly alters a disease microenvironment comprising the disease associated F2 fibroblasts (e.g. a tumor microenvironment comprising the disease associated F2 fibroblasts). In some embodiments, the FAP binding agent directly or indirectly polarizes the F2 fibroblast associated with a disease. In some embodiments, the FAP binding agent further comprises a signaling agent, e.g., without limitation, an interferon, an interleukin, and a tumor necrosis factor, that may be modified to attenuate their activity. In some embodiments, the FAP binding agent comprises additional targeting moieties that bind to other targets (e.g., antigens or receptors) of interest. In another embodiment, the other targets (e.g., antigens or receptors) of interest are present on fibroblast cells. In some embodiments, the other targets (e.g., antigens or receptors) of interest are present on fibroblast cells in cancer stroma. In some embodiments, the present fibroblast binding agent may directly or indirectly recruit an immune cell (e.g., a dendritic cell) to a site of action (such as, by way of non-limiting example, the tumor microenvironment). In some embodiments, the present FAP binding agent facilitates the presentation of antigens (e.g., antigens or receptors) by immune cells (e.g., dendritic cells, macrophages) in tumor stroma or directly by fibroblast cells.

In some embodiments, these FAP binding agents bind to, but do not functionally modulate (e.g., partially or fully neutralize) FAP. Therefore, in some embodiments, the present FAP binding agents have use in, for instance, directly or indirectly recruiting a FAP-expressing cell to a site of interest while still allowing the FAP-expressing cell to signal via FAP (i.e., the binding of the FAP binding agent does not reduce or eliminate FAP signaling at the site of interest). Conversely, in some embodiments, the present FAP binding agents have use in, for instance, directly or indirectly recruiting a FAP-expressing cell to a site of interest while not allowing the FAP-expressing cell to signal via FAP (i.e., the binding of the FAP binding agent reduces or eliminates FAP signaling at the site of interest). In some embodiments, the FAP targeting moiety is a single domain antibody (VHH).

In another aspect, the present technology relates to chimeric proteins or Fc-based chimeric protein complexes that have the FAP binding agents disclosed herein or have at least one targeting moiety that targets or binds to FAP. In another aspect, the FAP binding agents or the chimeric proteins or Fc-based chimeric protein complexes, disclosed herein, are useful in methods for the treatment of various diseases or disorders such as cancer, infections, inflammatory diseases or conditions, immune disorders, fibrotic diseases and other diseases and disorders.

In another aspect, one or more targeting moieties (i.e., FAP binding agents) and one or more signaling agents are conjugated to Fc domain(s) to form an Fc-based chimeric protein complex. In some embodiments, the one or more targeting moieties (i.e., FAP binding agents) and the one or more signaling agents are attached directly to the Fc domain(s) or attached via a linker. Such Fc-based chimeric protein complexes, surprisingly, have dramatically improved half-lives in vivo, as compared to chimeras lacking an Fc and, especially in the heterodimer configuration as described herein, are particularly amendable to production and purification. Accordingly, the present Fc-based chimeric protein approach yields agents that are particularly suited for use as therapeutics.

In another aspect, the present technology relates to FAP binding agents, chimeric proteins, or Fc-based chimeric protein complexes that are cross-reactive across human, mouse and cynomolgus.

BRIEF DESCRIPTION OF DRAWINGS

FIG. 2A shows the data for 2PE14, FIG. 2B shows the data for 2PE17, FIG. 2C shows the data for 2PE36, FIG. 2D shows the data for 2PE40, FIG. 2E shows the data for 2PE42, FIG. 2F shows the data for 2PE44, FIG. 2G shows the data for 3PE12, FIG. 2H shows the data for 3PE42, FIG. 2I shows the data for 3PE57, FIG. 2J shows the data for 3PE93, and FIG. 2K shows the data for 3PE94.

FIG. 3A shows the data for IFNα2, FIG. 3B shows the data for 2PE14-AFN, FIG. 3C shows the data for 3PE12-AFN, and FIG. 3D shows the data for 3PE42-AFN.

FIGS. 5A-F, 6A-H, 7A-H, 8A-D, 9A-F, 10A-J, 11A-D, 12A-F, 13A-J, 14A-F, 15A-L, 16A-L, 17A-F, 18A-L, 19A-L, 20A-J, 21A-J, 22A-F, and 23A-F show various non-limiting illustrative schematics of the Fc-based chimeric protein complexes of the present invention. In embodiments, each schematic is a composition of the present invention. Where applicable in the figures, "TM" refers to a "targeting moiety" as described herein. "SA" refers to a "signaling agent" as described herein. "⌐" is an optional "linker" as described herein. The two long parallel rectangles are human Fc domains, e.g. from IgG1, from IgG2, or from IgG4, as described herein and, optionally, with effector knock-out and/or stabilization mutations as also described herein. The two long parallel rectangles with one having a protrusion and the other having an indentation are human Fc domains, e.g. from IgG1, from IgG2, or from IgG4 as described herein with knob-in-hole and/or ionic pair (a/k/a charged pairs, ionic bond, or charged residue pair) mutations as described herein and, optionally, with effector knock-out and/or stabilization mutations as also described herein.

FIGS. 5A-F show illustrative homodimeric 2-chain complexes. These figures show illustrative configurations for the homodimeric 2-chain complexes.

Figures 6A, 6B, 6C, 6D:
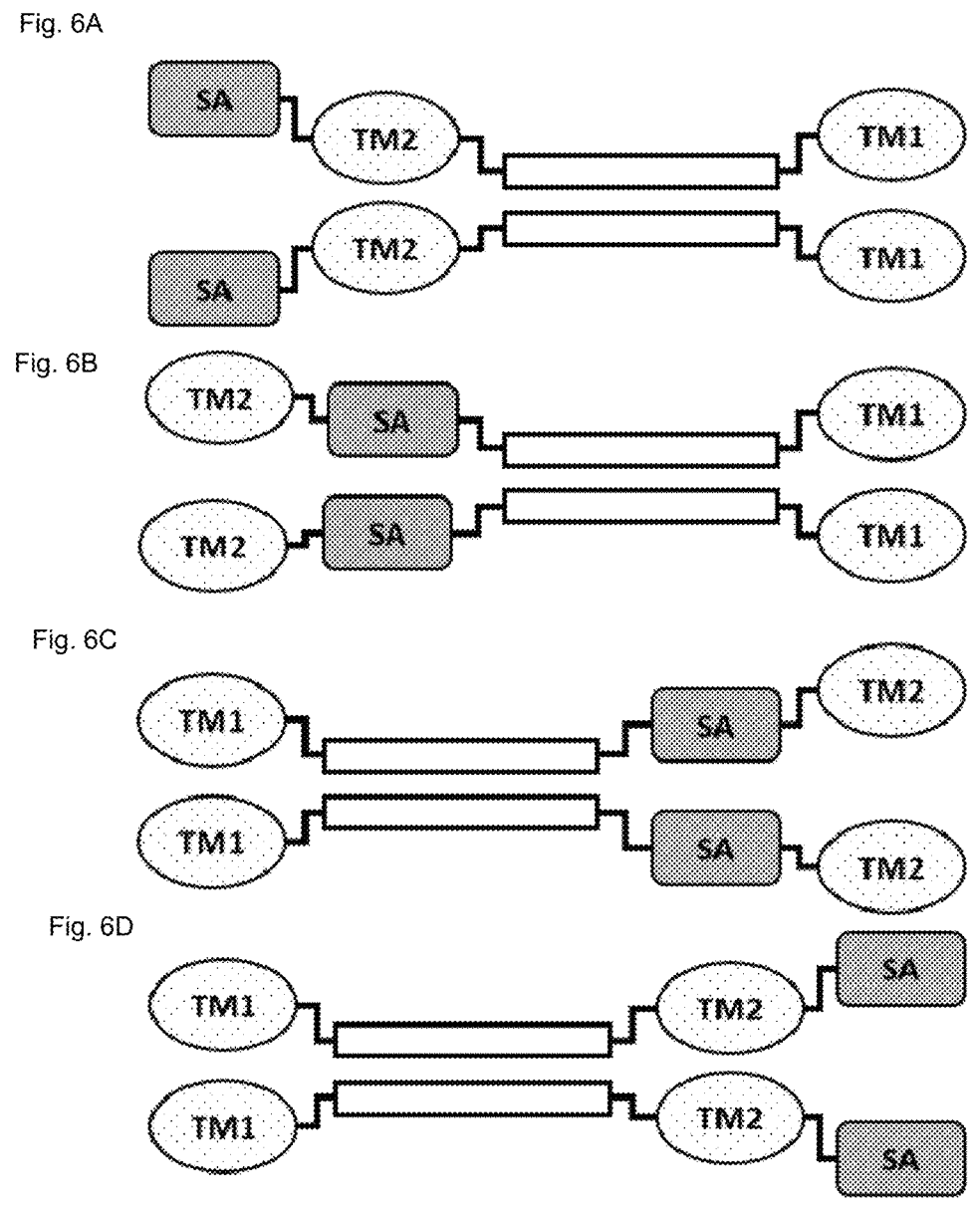

FIGS. 6A-H show illustrative homodimeric 2-chain complexes with two targeting moieties (TM) (as described herein, more targeting moieties may be present in some embodiments). In embodiments, the position of TM1 and TM2 are interchangeable. In embodiments, the constructs shown in the box (i.e., FIGS. 6G and 6H) have signaling agent (SA) between TM1 and TM2 or between TM1 and Fc.

FIGS. 7A-H show illustrative homodimeric 2-chain complexes with two signaling agents (as described herein, more signaling agents may be present in some embodiments). In embodiments, the position of SA1 and SA2 are interchangeable. In embodiments, the constructs shown in the box (i.e., FIGS. 7G and 7H) have TM between SA1 and SA2 or TM at N- or C-terminus.

Figures 8A, 8B, 8C, 8D:
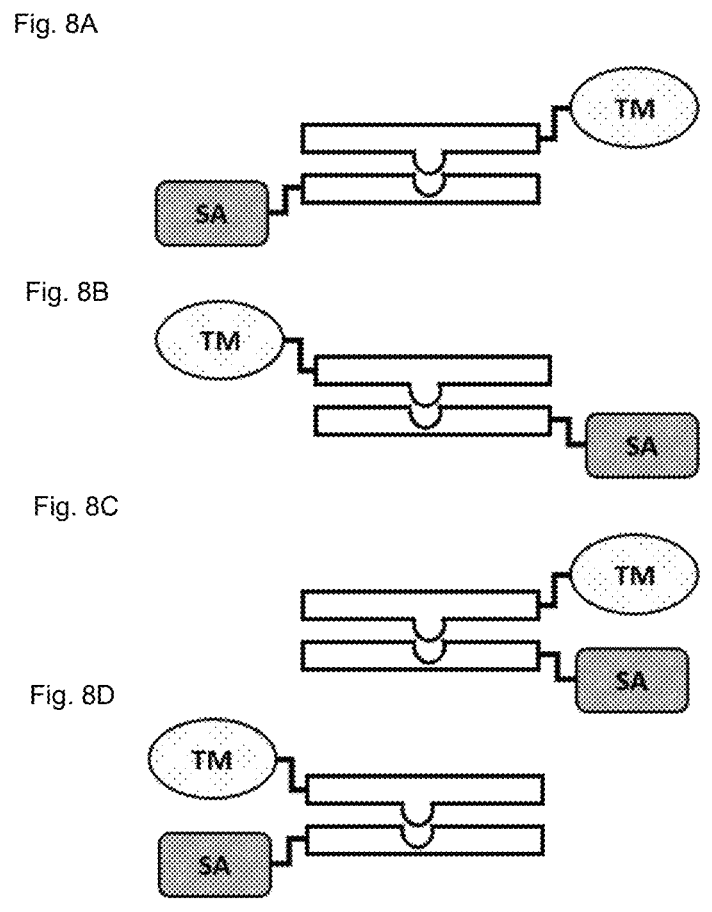

FIGS. 8A-D show illustrative heterodimeric 2-chain complexes with split TM and SA chains, namely the TM on the knob chain of the Fc and the SA on hole chain of the Fc.

FIGS. 9A-F show illustrative heterodimeric 2-chain complexes with split TM and SA chains, namely with both TMs on the knob chain of the Fc and with SA on hole chain of the Fc, with two targeting moieties (as described herein, more targeting moieties may be present in some embodiments). In embodiments, the position of TM1 and TM2 are interchangeable. In some embodiments, TM1 and TM2 can be identical.

FIGS. 10A-J show illustrative heterodimeric 2-chain complexes with split TM and SA chains, namely with TM on the knob chain of the Fc and with a SA on the hole chain of the Fc, with two signaling agents (as described herein, more signaling agents may be present in some embodiments). In these orientations/configurations, one SA is on the knob chain and one SA is on the hole chain. In embodiments, the position of SA1 and SA2 are interchangeable.

US 12,583,941 B2

5

Figure 1:
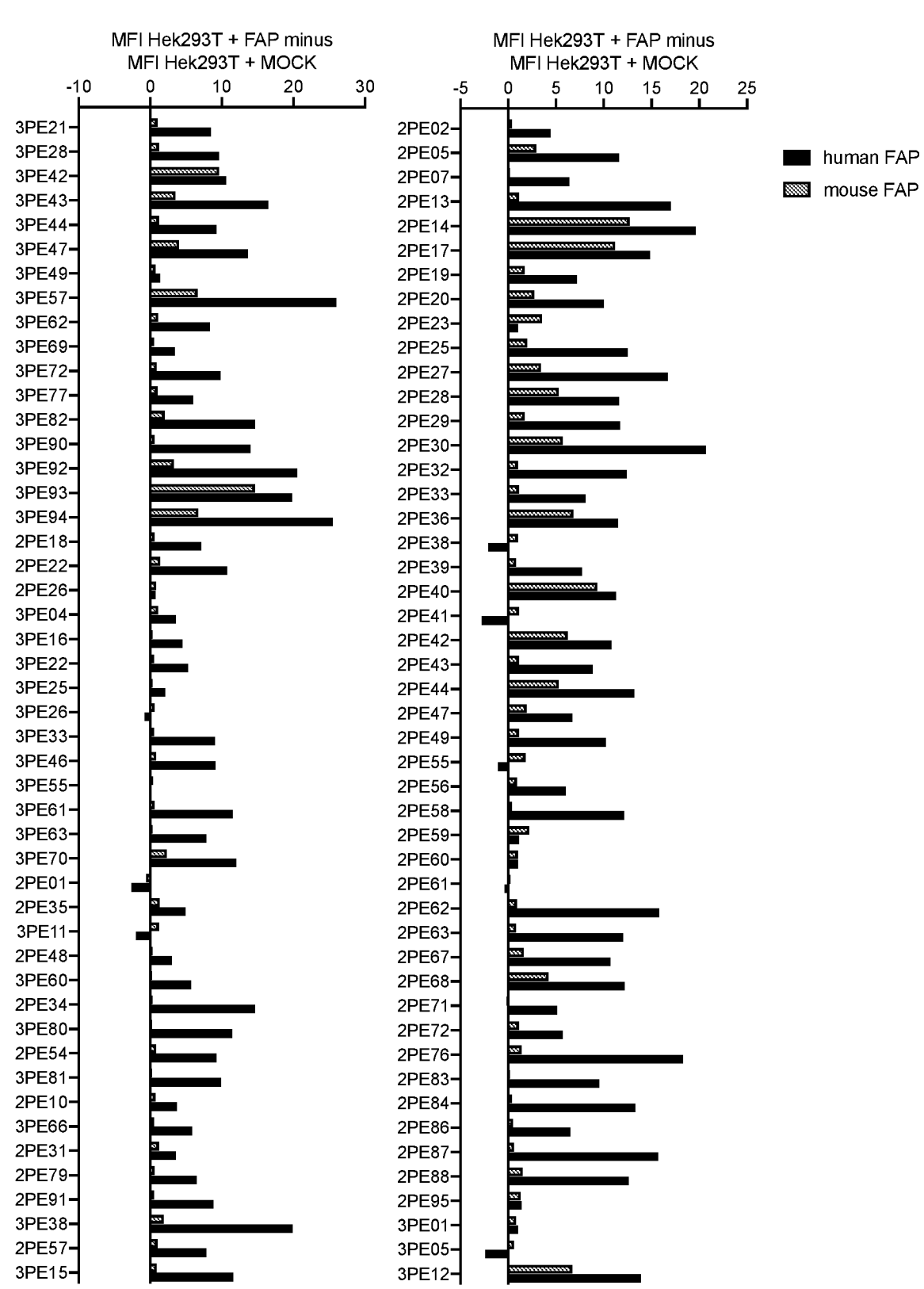
FIG. 1 shows Fluorescence-activated cell sorting (FACS) data for FAP VHH binding. FAP VHH periplasmic extracts were applied to HEK293T cells transiently transfected with human FAP, mouse FAP or an empty vector (MOCK). Binding was measured and plotted as the difference in mean fluorescent intensity (MFI) between FAP and MOCK transfected cells.

FIGS. 11A-D show illustrative heterodimeric 2-chain complexes with split TM and SA chains, namely the SA on the knob chain of the Fc and the TM on hole chain of the Fc.

FIGS. 12A-F show illustrative heterodimeric 2-chain complexes with split TM and SA chains, namely with SA on the knob chain of the Fc and both TMs on hole chain of the Fc, with two targeting moieties (as described herein, more targeting moieties may be present in some embodiments). In embodiments, the position of TM1 and TM2 are interchangeable. In some embodiments, TM1 and TM2 can be identical.

FIGS. 13A-J show illustrative heterodimeric 2-chain complexes with split TM and SA chains, namely with SA on the knob chain of the Fc and TM on hole chain of the Fc, with two signaling agents (as described herein, more signaling agents may be present in some embodiments). In these orientations/configurations, one SA is on the knob chain and one SA is on the hole chain. In embodiments, the position of SA1 and SA2 are interchangeable.

FIGS. 14A-F show illustrative heterodimeric 2-chain complexes with TM and SA on the same chain, namely the SA and TM both on the knob chain of the Fc.

FIGS. 15A-L show illustrative heterodimeric 2-chain complexes with a TM and a SA on the same chain, namely with SA and with TM both on the knob chain of the Fc, with two targeting moieties (as described herein, more targeting moieties may be present in some embodiments). In embodiments, the position of TM1 and TM2 are interchangeable. In some embodiments, TM1 and TM2 can be identical.

FIGS. 16A-L show illustrative heterodimeric 2-chain complexes with a TM and a SA on the same chain, namely with SA and with TM both on the knob chain of the Fc, with two signaling agents (as described herein, more signaling agents may be present in some embodiments). In embodiments, the position of SA1 and SA2 are interchangeable.

FIGS. 17A-F show illustrative heterodimeric 2-chain complexes with TM and SA on the same chain, namely the SA and TM both on the hole chain of the Fc.

FIGS. 18A-L show illustrative heterodimeric 2-chain complexes with a TM and a SA on the same chain, namely with SA and with TM both on the hole chain of the Fc, with two targeting moieties (as described herein, more targeting moieties are present in some embodiments). In embodiments, the position of TM1 and TM2 are interchangeable. In embodiments, TM1 and TM2 can be identical.

FIGS. 19A-L show illustrative heterodimeric 2-chain complexes with a TM and a SA on the same chain, namely with SA and with TM both on the hole chain of the Fc, with two signaling agents (as described herein, more signaling agents may be present in some embodiments). In embodiments, the position of SA1 and SA2 are interchangeable.

FIGS. 20A-J show illustrative heterodimeric 2-chain complexes with two targeting moieties (as described herein, more targeting moieties may be present in some embodiments) and with SA on knob Fc and TM on each chain. In embodiments, TM1 and TM2 can be identical.

FIGS. 21A-J show illustrative heterodimeric 2-chain complexes with two targeting moieties (as described herein, more targeting moieties may be present in some embodiments) and with SA on hole Fc and TM on each chain. In embodiments, TM1 and TM2 can be identical.

FIGS. 22A-F show illustrative heterodimeric 2-chain complexes with two signaling agents (as described herein, more signaling agents may be present in some embodiments) and with split SA and TM chains: SA on knob and TM on hole Fc.

FIGS. 23A-F show illustrative heterodimeric 2-chain complexes with two signaling agents (as described herein, more signaling agents may be present in some embodiments) and with split SA and TM chains: TM on knob and SA on hole Fc.

FIGS. 24A-H show sensorgrams of FAP VHH variants binding to biotinylated FAP in bio-layer interferometry (BLI).

DETAILED DESCRIPTION

The present technology is based, in part, on the discovery of fibroblast binding agents or fibroblast activation protein binding agents (e.g., antibodies, such as, by way of non-limiting example, VHHs) that recognize, target, or bind to fibroblasts or to fibroblast activation protein. In some embodiments, the present fibroblast binding agents are part of a chimeric or fusion protein or a Fc-based chimeric protein complex with one or more targeting moieties and/or one or more signaling agents.

In some embodiments, the fibroblast binding agent or fibroblast activation protein binding agents target F2 fibroblasts. In some embodiments, the fibroblast binding agent or FAP binding agent directly or indirectly alters a disease microenvironment comprising the disease associated F2 fibroblasts (e.g. a tumor microenvironment comprising the F2 fibroblasts). In some embodiments, the fibroblast binding agent or FAP binding agent directly or indirectly polarizes the F2 fibroblast into F1 fibroblast, where in some instances, the fibroblast is associated with a disease.

F2 fibroblast(s) refers to pro-tumorigenic (or tumor promoting) cancer-associated fibroblasts (CAFs) (a/k/a Type II-CAF). F1 fibroblast(s) refers to tumor suppressive CAFs (a/k/a Type I-CAF). Polarization refers to changing the phenotype of cell, e.g. changing a tumorigenic F2 fibroblast to a tumor suppressive F1 fibroblast.

In some embodiments, the fibroblast binding agent or FAP binding agent targets a FAP marker. In some embodiments, the fibroblast binding agent or FAP binding agent comprises a FAP targeting moiety. In some embodiments, the fibroblast binding agent's or FAP binding agent's FAP targeting moiety is any FAP targeting moiety disclosed herein In some embodiments, fibroblast binding agent or FAP binding agent comprises an amino acid sequence having at least 90% sequence similarity with any one of SEQ ID NO: 2-42 or 46-86.

In some embodiments, fibroblast binding agent or FAP binding agent further comprises one or more signaling agents. In some embodiments, the signaling agent is selected from one or more of an interferon, an interleukin, and a tumor necrosis factor, any of which are optionally modified.

In some embodiments, a fibroblast binding agent or FAP binding agent further comprising one or more signaling agents directly or indirectly alters a disease microenvironment comprising the disease associated F2 fibroblasts (e.g. a tumor microenvironment comprising the F2 fibroblasts). In some embodiments, the fibroblast binding agent or FAP binding agent further comprising one or more signaling agents directly or indirectly polarizes the F2 fibroblast into F1 fibroblast.

In some embodiments, fibroblast binding agent or FAP binding agent further comprises one or more additional targeting moieties. In some embodiments, the one or more additional targeting moieties recognize and optionally functionally modulate a tumor antigen. In some embodiments, the one or more additional targeting moieties recognize and optionally functionally modulate an antigen on an immune cell.

In some embodiments, the immune cell is selected from a T cell, a B cell, a dendritic cell, a macrophage, neutrophil, and a NK cell.

In some embodiments, the fibroblast binding agent or FAP binding agent recruits cytotoxic T cells to tumor cells or to the tumor environment.

In some embodiments, the fibroblast binding agent or FAP binding agent recognizes and binds FAP without substantially functionally modulating its activity.

In another aspect, the present technology is based, in part, on the discovery of agents (e.g., antibodies, such as, by way of non-limiting example, VHHs) that recognize and bind to fibroblast activation protein (FAP). In some embodiments, the present FAP binding agents are part of a chimeric or fusion protein or Fc-based chimeric protein complex with one or more targeting moieties and/or one or more signaling agents. In some embodiments, these FAP binding agents bind to, but do not functionally modulate FAP. In some embodiments, the FAP binding agents may bind and directly or indirectly recruit immune cells to sites in need of therapeutic action (e.g., a tumor or tumor microenvironment). In some embodiments, the FAP binding agents enhance tumor antigen presentation for elicitation of effective antitumor immune response.

In some embodiments, the FAP binding agents modulate antigen presentation. In some embodiments, the FAP binding agents temper the immune response to avoid or reduce autoimmunity. In some embodiments, the FAP binding agents provide immunosuppression. In some embodiments, the FAP binding agents cause an increase a ratio of Tregs to CD8+ T cells and/or CD4+ T cells in a patient. In some embodiments, the present methods relate to reduction of auto-reactive T cells in a patient.

In some embodiments, the present technology provides pharmaceutical compositions comprising the FAP binding agents and their use in the treatment of various diseases, including fibrotic diseases. In some embodiments, the present technology provides pharmaceutical compositions comprising the FAP binding agents and their use in the treatment of various diseases, including cancer, autoimmune, and/or neurodegenerative diseases.

In some embodiments, the present FAP binding agents are used to target to cancer-associated fibroblasts (CAFs). For instance, in various embodiments, the present FAP binding agents target fibroblasts within a tumor stroma, e.g. in the treatment of a cancer, e.g. an epithelial-derived cancer such as a carcinoma. As CAFs are central to regulating the dynamic and reciprocal interactions that occur among the malignant epithelial cells, the extracellular matrix (ECM), and the numerous noncancerous cells that are frequently found within the tumor milieu, including endothelial, adipose, inflammatory, and immune cells, the present FAP binding agents provide a way to deliver crucial anti-tumor therapies (e.g. a modified cytokine and/or additional targeting moieties as described elsewhere herein) to a site of interest. In various embodiments, the present FAP binding agents target to a stromal microenvironment composed of activated fibroblasts, endothelial cells (ECs) involved in tubulogenesis, and extracellular matrix (ECM) that is constantly remodeled to accommodate growth of a tumor. Accordingly, e.g. in the context of a chimera (or chimera complex) with a cytokine, optionally with additional targeting moieties, the present FAP binding agents can deliver an anti-tumor signal to the stromal microenvironment which is crucial for tumor development. In various embodiments, the FAP-binding agents are used to target to the membranes of cells critical to tumor niche formation in primary tumors or metastases, such as, cancer-associated fibroblasts, MSCs, selected cancer cells, and endothelial cells.

FAP Binding Agents

Fibroblast activation protein (FAP) is a 170 kDa melanoma membrane-bound gelatinase that belongs to the serine protease family. FAP is selectively expressed in reactive stromal fibroblasts of epithelial cancers, granulation tissue of healing wounds, and malignant cells of bone and soft tissue sarcomas. FAP is believed to be involved in the control of fibroblast growth or epithelial-mesenchymal interactions during development, tissue repair, and epithelial carcinogenesis In some embodiments, the present FAP binding agent is a protein-based agent capable of specific binding to FAP. In some embodiments, the present FAP binding agent is a protein-based agent capable of specific binding to FAP without functional modulation (e.g., partial or full neutralization) of FAP.

In some embodiments, the FAP binding agent of the present technology comprises a targeting moiety having an antigen recognition domain that recognizes an epitope present on FAP. In some embodiments, the antigen-recognition domain recognizes one or more linear epitopes present on FAP. As used herein, a linear epitope refers to any continuous sequence of amino acids present on FAP. In another embodiment, the antigen-recognition domain recognizes one or more conformational epitopes present on FAP. As used herein, a conformation epitope refers to one or more sections of amino acids (which may be discontinuous), which form a three-dimensional surface with features and/or shapes and/or tertiary structures capable of being recognized by an antigen recognition domain.

In some embodiments, the FAP binding agent of the present technology may bind to the full-length and/or mature forms and/or isoforms and/or splice variants and/or fragments and/or any other naturally occurring or synthetic analogs, variants, or mutants of human FAP. In some embodiments, the FAP binding agent of the present technology may bind to any forms of the human FAP, including monomeric, dimeric, heterodimeric, multimeric and associated forms. In an embodiment, the FAP binding agent binds to the monomeric form of FAP. In another embodiment, the FAP binding agent binds to a dimeric form of FAP. In a further embodiment, the FAP binding agent binds to glycosylated form of FAP, which may be either monomeric or dimeric.

In an embodiment, the present FAP binding agent comprises a targeting moiety with an antigen recognition domain that recognizes one or more epitopes present on human FAP. In some embodiments, the human FAP comprises the amino acid sequence of:

```
                                    (SEQ ID NO: 1)
MKTWVKIVFGVATSAVLALLVMCIVLRPSRVHNSEENTMRALTLKDILNG

TFSYKTFFPNWISGQEYLHQSADNNIVLYNIETGQSYTILSNRTMKSVN

ASNYGLSPDRQFVYLESDYSKLWRYSYTATYYIYDLSNGEFVRGNELPR

PIQYLCWSPVGSKLAYVYQNNIYLKQRPGDPPFQITFNGRENKIFNGIP

DWVYEEEMLPTKYALWWSPNGKFLAYAEFNDKDIPVIAYSYYGDEQYPR

TINIPYPKAGAKNPWVRIFIIDTTYPAYVGPQEVPVPAMIASSDYYFSW
```

-continued

```
LTWTDERVCLQWLKRVQNVSVLSICDFREDWQTWDCPKTQEHIEESRTG

WAGGFFVSRPVFSYDAISYYKIFSDKDGYKHIHYIKDTVENAIQITSGK

WEAINIFRVTQDSLFYSSNEFEEYPGRRNIYRISIGSYPPSKKCVTCHL

RKERCQYYTASFSDYAKYYALVCYGPGIPISTLHDGRTDQEIKILEENK

ELENALKNIQLPKEEIKKLEVDEITLWYKMILPPQFDRSKKYPLLIQVY

GGPCSQSVRSVFAVNWISYLASKEGMVIALVDGRGTAFQGDKLLYAVYR

KLGVYEVEDQITAVRKFIEMGFIDEKRIAIWGWSYGGYVSSLALASGTG

LFKCGIAVAPVSSWEYYASVYTERFMGLPTKDDNLEHYKNSTVMARAEY

FRNVDYLLIHGTADDNVHFQNSAQIAKALVNAQVDFQAMWYSDQNHGLS

GLSTNHLYTHMTHFLKQCFSLSD.
```

In some embodiments, the present FAP binding agent comprises a targeting moiety capable of specific binding. In some embodiments, the FAP binding agent comprises a targeting moiety having an antigen recognition domain such as an antibody or derivatives thereof. In an embodiment, the FAP binding agent comprises a targeting moiety that is an antibody. In some embodiments, the antibody is a full-length multimeric protein that includes two heavy chains and two light chains. Each heavy chain includes one variable region (e.g., $V_H$) and at least three constant regions (e.g., $CH_1$, $CH_2$ and $CH_3$), and each light chain includes one variable region ($V_L$) and one constant region ($C_L$). The variable regions determine the specificity of the antibody. Each variable region comprises three hypervariable regions also known as complementarity-determining regions (CDRs) flanked by four relatively conserved framework regions (FRs). The three CDRs, referred to as CDR1, CDR2, and CDR3, contribute to the antibody binding specificity. In some embodiments, the antibody is a chimeric antibody. In some embodiments, the antibody is a humanized antibody.

In some embodiments, the FAP binding agent comprises a targeting moiety that is an antibody derivative or format. In some embodiments, the present FAP binding agent comprises a targeting moiety which is a single-domain antibody, a recombinant heavy-chain-only antibody (VHH), a single-chain antibody (scFv), a shark heavy-chain-only antibody (VNAR), a microprotein (cysteine knot protein, knottin), a DARPin; a Tetranectin; an Affibody; a Transbody; an Anticalin; an AdNectin; an Affilin; an Affimer, a Microbody; an aptamer; an alterase; a plastic antibody; a phylomer; a stradobody; a maxibody; an evibody; a fynomer, an armadillo repeat protein, a Kunitz domain, an avimer, an atrimer, a probody, an immunobody, a triomab, a troybody; a peptbody; a vaccibody, a UniBody; a DuoBody, a Fv, a Fab, a Fab', a F(ab')2, a peptide mimetic molecule, or a synthetic molecule, as described in US Patent Nos. or Patent Publication Nos. U.S. Pat. No. 7,417,130, US 2004/132094, U.S. Pat. No. 5,831,012, US 2004/023334, U.S. Pat. Nos. 7,250, 297, 6,818,418, US 2004/209243, U.S. Pat. Nos. 7,838,629, 7,186,524, 6,004,746, 5,475,096, US 2004/146938, US 2004/157209, U.S. Pat. Nos. 6,994,982, 6,794,144, US 2010/239633, U.S. Pat. No. 7,803,907, US 2010/119446, and/or U.S. Pat. No. 7,166,697, the contents of which are hereby incorporated by reference in their entireties. See also, Storz MAbs. 2011 May-June; 3(3): 310-317.

In some embodiments, the FAP binding agent comprises a targeting moiety that is a single-domain antibody, such as a VHH. The VHH may be derived from, for example, an organism that produces VHH antibody such as a camelid, a shark, or the VHH may be a designed VHH. VHHs are antibody-derived therapeutic proteins that contain the unique structural and functional properties of naturally-occurring heavy-chain antibodies. VHH technology is based on fully functional antibodies from camelids that lack light chains. These heavy-chain antibodies contain a single variable domain (VHH) and two constant domains (CH2 and CH3). VHHs are commercially available under the trademark of NANOBODY or NANOBODIES.

In an embodiment, the FAP binding agent comprises a VHH. In some embodiments, the VHH is a humanized VHH or camelized VHH.

In some embodiments, the VHH comprises a fully human VH domain, e.g. a HUMABODY (Crescendo Biologics, Cambridge, UK). In some embodiments, fully human VH domain, e.g. a HUMABODY is monovalent, bivalent, or trivalent. In some embodiments, the fully human VH domain, e.g. a HUMABODY is mono- or multi-specific such as monospecific, bispecific, or trispecific. Illustrative fully human VH domains, e.g. a HUMABODIES are described in, for example, WO 2016/113555 and WO 2016/113557, the entire disclosures of which are incorporated by reference.

By way of example, but not by way of limitation, in some embodiments, a human VHH FAP binding agent comprises an amino acid sequence selected from the following sequences:

```
2PE2:
                                                    (SEQ ID NO: 2)
QVQLQESGGGSVQVGGSLRLSCADSGSTFTINAMGWYRQAPGKRRDWAGITSSGVTQYPDSVKGRFTISRDNAKN
TVYLQMNSLKPEDTAVYYCNLWPPRASPSGRIYWGQGTQVTVSS

2PE5:
                                                    (SEQ ID NO: 3)
QVQLQESGGGLVQPGGSLRLSCAASESTFSINAVAWYRQAPGKRRELVAGISGGGVTSYPDSVKGRFTISRDNAKNIV
YLQMSSLKPEDTAVYYCNLWPPRASPGGRVYWGQGTQVTVSS

2PE7:
                                                    (SEQ ID NO: 4)
QVQLQESGGGLVHAGGSLRLSCADSGSTFSVNAVGWYRQAPGKRRDVWAGITSDGVTNYPDSVKGRFTISRDNAKN
TVYLQMNSLKPEDTAVYYCNLWPPRASPSGRIYWGQGTQVTVSS

2PE13:
                                                    (SEQ ID NO: 5)
QVQLQESGGGLVQVGGSLRLSCAASGSTFILNAMAWYRQAPGNRRELVAGISSGGDTNYPDSVKGRFTISRDNANNIV
YLQMNSLKLEDTAVYYCNLWPPRASPSGRVYWGQGTQVTVSS
```

-continued

2PE14:

(SEQ ID NO: 6)

QVQLQESGGGLVQPGGSLRLSCAASGSTFSINAVAWYRQAPGKRRELVAGISGGGVTNYPDSVKGRFTISRDNAKNT
VYLQMSSLKPEDTAVYYCNLWPPRASPGGRVYWGQGTQVTVSS

2PE17:

(SEQ ID NO: 7)

QVQLQESGGGLVQSGGSLRLSCAASGSTFSINAVAWYRQAPGKRRELVAGISGGGVTNYPDSVKGRFTISRDNAKNT
VYLQMSSLKPEDTAVYYCNLWPPRASPGGRVYWGQGTQVTVSS

2PE19:

(SEQ ID NO: 8)

QVQLQESGGGLVQPGGSLRLSCADSGSTFTINAMAWYRQAPGKRRELVAGISGGGVTNYPDSVKGRFTISRDNAKNTV
YLQMSSLKPEDTAVYYCNLWPPRASPDGRVYWGQGTQVTVSS

2PE20:

(SEQ ID NO: 9)

QVQLQESGGGLVQPGGSLRLSCAASESTFSINAVAWYRQAPGKRRELVAGISGGGVTNYPDSVKGRFTVSRDNAKNI
VYLQMSSLKPEDTAVYYCNLWPPRASPGGRVYWGQGTQVTVSS

2PE23:

(SEQ ID NO: 10)

QVQLQESGGGLVQPGGSLRLSCADSGSTFSINNAMGWYRQAPGKRRDWVAGITSSGVTNYPDSVKGRFTISRDNAK
NTVYLQMNSLKPEDTAVYYCNLWPPRASPSGTIYWGQGTQVTVSS

2PE25:

(SEQ ID NO: 11)

QVQLQESGGGLVQVGGSLRLSCAASGSSFIINAMGWYRQAPGKRRELVAGISSDGATHYPDSVKGRFTISRDNAKNIV
YLQMNSLKPEDTAVYYCNLWPPRASPSGRVYWGQGTQVTVSS

2PE27:

(SEQ ID NO: 12)

QVQLQESGGGLVQPGGSLRLSCAASGSISSINAMAWYRQAPGKRRELVAGIDGGGVTNYPDSVKGRFTISRDNAKNT
VYLQMSSLKPEDTAVYYCNLWPPRASPGGRVYWGQGTQVTVSS

2PE28:

(SEQ ID NO: 13)

QVQLQESGGGLVQIGGSLRLSCADSGSTFSINNAMGWYRQAPGKRRDWVAGITSSGVTNYPDSVKGRFTISRDNAKN
TVYLQMNSLKPEDTAVYYCNLWPPRASPSGTIYWGQGTQVTVSS

2PE29:

(SEQ ID NO: 14)

QVQLQESGGGLVQPGGSLRLSCAASGSTSSINAMAWYRQAPGKRRELVAGIDGGGVTNYPDSVKGRFTISRDNAKNT
VYLQMSSLKPEDTAVYYCNLWPPRASPGGRVYWGQGTQVTVSS

2PE30:

(SEQ ID NO: 15)

QVQLQESGGGLVQVGGSLRLSCADSGSTFSINNAMGWYRQAPGKRRDWVAGITSSGVTNYPDSVKGRFTISRDNAK
NTVYLQMNSLKPEDTAVYYCNLWPPRASPSGRIYWGQGTQVTVSS

2PE32:

(SEQ ID NO: 16)

QVQLQESGGGLVQVGGSLRLSCAASGSTFSINAMGWYRQAPGKRRELVAGISSDDITYYPDSVKGRFTISRDNAKNTV
YLQMNSLKPEDTAVYYCNLWPPRASPSGRGYWGQGTQVTVSS

2PE33:

(SEQ ID NO: 17)

QVQLQESGGGLVQPGGSLRLSCADSGSTFSINSMGWYRQAPGKRRDWVAGITTDGITKYPDSLKGRFTISRDNAKNT
VYLQMNSLKPEDTAVYYCNLWPPRASPSGRLYWGQGTQVTVSS

2PE36:

(SEQ ID NO: 18)

QVQLQESGGGLVQPGGSLRLSCAASGSTFSINAVAWYRQAPGKRRELVAGISGGGVTNYPDSVKGRFTISRDNAKNT
VYLQMSSLKPEDTAVYYCNLWPPRASPDGRVYWGQGTQVTVSS

2PE38:

(SEQ ID NO: 19)

QVQLQESGGGLVQAGESLRLSCAASGSTFTINAMGWYRXAPGKRRDWVAGITSSGVTQYPDSVKGRFTISRDNAKNT
VYLQMNSLKPEDTAVYYCNLWPPRASPSGRIYWGQGTQVTVSS

2PE39:

(SEQ ID NO: 20)

QVQLQESGGGLVQVGGSLRLSCADSGSTFSVNAVGWYRQAPGKRRDVWAGITSDGVTNYPDSVKGRFTISRDNAKN
TVYLQMNSLKPEDTAVYYCNLWPPRASPSGRIYWGQGTQVTVSS

2PE40:

(SEQ ID NO: 21)

QVQLQESGGGLVQPGGSLRLSCAASESTFSINAVAWYRQAPGKRRELVAGISGGGVTNYPDSVKGRFTISRDNAKNIV
YLQMSSLKPEDTAVYYCNLWPPRASPGGRVYWGQGTQVTVSS

-continued

2PE41:

(SEQ ID NO: 22)

QVQLQESGGGLVQVGGSLRLSCADSGSTFSINSMGWYRQAPGKHRDWAGITTDGITKYPDSLKGRFTISRDNAKNT
VYLQMNSLKPEDTAVYYCNLWPPRASPSGRLYWGQGTQVTVSS

2PE42:

(SEQ ID NO: 23)

QVQLQESGGGLVQAGGSLRLSCAASGSTFSINAVAWYRQAPGKRRELVAGISGGGVTNYPDSVRGRFTISRDNAKNT
VYLQMSSLKPEDTAVYYCNLWPPRASPDGRVYWGQGTQVTVSS

2PE43:

(SEQ ID NO: 24)

QVQLQESGGGLVQPGGSLTLACKGSGVELSRSAMAWYQQAPGKRRDWVAGITSSGVTQYPDSVKGRFTISRDNAKN
TVYLQMNSLKPEDAAVYYCNLWPPRASPSGRIYWGQGTQVTVSS

2PE44:

(SEQ ID NO: 25)

QVQLQESGGGLVQPGGSLRLSCAASGSTFSVNAVAWYRQAPGKRRELVAGISGGGVTNYPDSVKGRFTISRDNAKNT
VYLQMSSLIPEDTAVYYCNLWPPRASPGGRVYWGQGTQVTVSS

2PE47:

(SEQ ID NO: 26)

QVQLQESGGGLVQVGGSLRLSCAASGSTFSINNAMGWYRQAPGKRREVWAGISSGGVTHYPDSVKGRFTISRDNAK
NIVYLQMDSLKPEDTAVYYCNLWPPRASPSGSIYWGQGTQVTVSS

2PE49:

(SEQ ID NO: 27)

QVQLQESGGGLVQAGGSLRLSCTASGSISSINAMAWYRQAPGKRRELVAGIDGGGVTNYPDSVKGRFTISRDNAKNT
VYLQMSSLKPEDTAVYYCNLWPPRASPGGRVYWGQGTQVTVSS

2PE55:

(SEQ ID NO: 28)

QVQLQESGGGLVQPGGSLRLSCAASESTFSINAVAWYRQAPGKRRELVAGISGGGVTNHPDSVKGRFTISRDNAKNIV
YLQMSSLKPEDTAVYYCNLWPPRASPGGRVYWGQGTQVTVSS

2PE56:

(SEQ ID NO: 29)

QVQLQESGGGLVQPGGSLRLSCADSGSTFTINAMGWYRQAPGKRRDVWAGITSSGVTQYPDSVKGRFTISRDNAKNT
VYLQMNSLKPEDTAVYYCNLWPPRASPSGRIYWGQGTQVTVSS

2PE58:

(SEQ ID NO: 30)

QVQLQESGGGLVQVGGSLRLSCAASGSTFSINAMGWYRQAPGKRREWVAGISSSGPPHYPDSVKGRFTISRDNAKNT
VYLQMNSLKPEDTAVYYCNLWPPMASPSGAIYWGQGTQVTVSS

2PE59:

(SEQ ID NO: 31)

QVQLQESGGGLVQPGGSLRLSCAVSGSIFSLNAMAWYRQAPGKRRELVAGISGGSVTNYPDSVKGRFTISRDSTKNT
VYLQMSSLKPEDTAVYYCNLWPPRASPGGRVYWGQGTQVTVSS

2PE60:

(SEQ ID NO: 32)

QVQLQESGGGLVQPGGSLRLSCAASGSTFSINAMAWYRQAPGKRRELVAGISGGGVTNYPDSVKGRFTISRDNAKNT
VYLQMSSLKPEDTAVYYCNLWPPRASPGGRVYWGQGTQVTVSS

2PE61:

(SEQ ID NO: 33)

QVQLQESGGGLVQPGGSLRLICAASGSTFSGNAMAWYRXAPGKRRELVAGISGGITTYPDSVKGRFTISRDNAKNTVY
LQMSSLKPEDTAVYYCNLWPPRASPGGLVYWGQGTQVTVSS

2PE62:

(SEQ ID NO: 34)

QVQLQESGGGLVQAGGSLRLSCADSSGSTFSINAMAWYRQAPGKRRDVWAGITSDSVTKYPDSVKGRFTISRDNAKN
TVYLQMNSLKPEDTAVYYCNLWPPRASPSGRIDWGQGTQVTVSS

2PE63:

(SEQ ID NO: 35)

QVQLQESGGGLVQVGGSLRLSCAASGSTFSINNAMGWYRQAPGKRREVWAGISSGGVTHYPDSVKGRFTISRDNAK
NIVYLQMNSLKPEDTAVYYCNLWPPRASPSGSIYWGQGTQVTVSS

2PE67:

(SEQ ID NO: 36)

QVQLQESGGGLVQVGGSLRLSCAASGSTFILNAMGWYRQAPGNRRELVAGISSGGDTNYPDSVKGRFTISRDNANNI
VYLQMNSLKLEDTAVYYCNLWPPRASPSGRPYWGQGTQVTVSS

2PE68:

(SEQ ID NO: 37)

QVQLQESGGGLVQPGGSLRLSCAASGSIFSTNAMAWYRQAPGKRRELVAGISGGGVTNYPDSVKGRFTISRDNAKNT
VYLQMSSLKPEDTAVYYCNLWPPRAPPDGRVYWGQGTQVTVSS

-continued

2PE71:

(SEQ ID NO: 38)
QVQLQESGGGMVQSGRSLRLSCLASVNIVNLNSVGWYRQAPGQQRELVASITSAGSTNYAESVKGRFTISRDNSKNT
VYLQMNSLKPSDTAVYYCNLWPPRVSPSGRGYWGQGTQVTVSS

2PE72:

(SEQ ID NO: 39)
QVQLQESGGGLVQPGGSLRLSCAASGSISSINAMAWYRQAPGRRRELVAGIDGGGVTNYPDSVKGRFTISRDHAKNT
VYLQMSSLKPEDTAVYYCNLWPPRASPGGRVYWGQGTQVTVSS

2PE76:

(SEQ ID NO: 40)
QVQLQESGGGLVQVGGSLRLSCAASGSTFSINNAMGWYRQAPGKRREVWAGISSGGVTHYPDSVKGRFAISRDNAK
NIVYLQMDSLKPEDTAVYYCNLWPPRASPSGSIYWGQGTQVTVSS

2PE83:

(SEQ ID NO: 41)
QVQLQESGGGLVQVGGSLRLSCADSGSTFSINSMGWYRQAPGKRRDWVAGITTDGITKYPDSLKGRFTISRDNAKNT
VYLQMNSLKPEDTAVYYCNLWPPRASPSGRLYWGQGTQVTVSS

2PE84:

(SEQ ID NO: 42)
QVQLQESGGGLVQAGGSLRLSCAASGSISSLNAMGWYRQAPGKQREWVAGITSGGSTNYADSVKGRFTILRDNAKNT
VYLQMSSLKFEDTAVYYCNLWPPRASPSGAVYWGQGTQVTVSS.

In various illustrative embodiments, the FAP binding agent comprises an amino acid sequence selected from any one of the sequences provided above with or without a terminal histidine tag sequence (i.e., HHHHHH; SEQ ID NO: 43).

In various illustrative embodiments, the FAP binding agent comprises an amino acid sequence selected from any one of the sequences provided above with or without a HA tag (i.e., YPYDVPDYGS; SEQ ID NO: 44).

In various illustrative embodiments, the FAP binding agent comprises an amino acid sequence selected from any one of the sequences provided above with or without an AM linker (i.e., AAA).

In various illustrative embodiments, the FAP binding agent comprises an amino acid sequence selected from any one of the sequences provided above with or without an AAA linker, HA tag, and terminal histidine tag sequence (i.e., AAAYPYDVPDYGSHHHHHH; SEQ ID NO: 45).

By way of example, but not by way of limitation, in some embodiments, a human VHH FAP binding agent comprises an amino acid sequence selected from the following sequences:

2PE86:

(SEQ ID NO: 46)
QVQLQESGGGLVQVGGSLRLSCADSGSTFSINAMGWYRQAPGKRRDWAGITSDGVTKYPDSVKGRFTISRDNAKNT
VYLQMNSLKPEDTAVYYCNLWPPRVSPSGRIYWGQGTQVTVSS

2PE87:

(SEQ ID NO: 47)
QVQLQESGGGLVQVGGSLRLSCAASGSTFSINNAMGWYRQAPGKRREVWAGISSGGVTHYPDSVKGRFTISRDNAK
NIVYLQMDSLKPEDTAAYYCNLWPPRASPSGSIYWGQGTQVTVSS

2PE88:

(SEQ ID NO: 48)
QVQLQESGGGLVQPGGSLRLSCAASESTFSINAVAWYRQAPGKRRELVAGISGGGVTNYPDSVKGRFTISRDNAKNIV
YLQMSSLKPEDTAVYYCNLWPPRAPPGGRVYWGQGTQVTVSS

2PE95:

(SEQ ID NO: 49)
QVQLQESGGGLVQVGGSLRLSCADSGSTFSINAMGWYRQAPGKRRDWAGITSSGVTKYPDSVKGRFTISRDNAKNT
VYLQMNSLKPEDTAVYYCNLWPPRASPSGRIYWGQGTQVTVSS

3PE1:

(SEQ ID NO: 50)
QVQLQESGGGLVQAGGSLKLSCAGSGSTFSINAMAWYRQAPGERRELVAGISGDNITNYPDSVKGRFTISRDNAKNTV
YLQMSSLKPEDTAVYYCNLWPPRASPGGRVYWGQGTQVTVSS

3PE5:

(SEQ ID NO: 51)
QVQLQESGGGLVQPGGSLRLSCAASGSTFSINAMAWYRQAPGQRRELVAGISGGGVTNYPDSVKGRFTISRDNAKNT
VYLQMSSLKPEDTAVYYCNLWPPRASPGGRVYWGQGTQVTVSS

3PE12:

(SEQ ID NO: 52)
QVQLQESGGGLVQPGGSLRLSCAASGSTFSGNAMAWYRQAPGKRRELVAGISGGGVTNYPDSVKGRFTISRDNAKN
TVYLQMSSLKPEDTAVYYCNLWPPRVSPGGGVYWGQGTQVTVSS

-continued

3PE21:

(SEQ ID NO: 53)

QVQLQESGGGLVQAGESLRLSCAASGRDFRDNSMGWYRQAPGKRREWVAGISSGGVTHYPDSVKGRFTISRDNAKN
IVYLQMDSLKPEDTAVYYCNLWPPRASPSGSIYWGQGTQVTVSS

3PE28:

(SEQ ID NO: 54)

QVQLQESGGGLVQPEGSLRLSCAASGSISSINAMAWYRQAPGKRRELVAGIDGGGVTNYPDSVKGRFTISRDNAKNTV
YLQMSSLKPEDTAVYYCNLWPPRASPGGRVYWGQGTQVTVSS

3PE42:

(SEQ ID NO: 55)

QVQLQESGGGLVQPGESLRLSCAVSGSTSSMNAMAWYRQAPGKRRELVAGISGGGATNYPDSVKGRFTISRDNAKN
TVYLQMSSLKPEDTAVYYCNLWPPRASPGGGVYWGQGTQVTVSS

3PE43:

(SEQ ID NO: 56)

QVQLQESGGGLVQAGGSLRLSCAASGSTFSVNAVAWYRQAPGKRRELVAGISGGGVTNYPDSVKGRFTISRDNAKNT
VYLQMSSLKPEDTAVYYCNLWPPRASPDGRVYWGQGTQVTVSS

3PE44:

(SEQ ID NO: 57)

QVQLQESGGGLVQPGGSLRLSCAASGSTFSINAMAWYRQAPGKRRELVAGISGGDVTHYPDSVKGRFTISRDNAKNT
VYLQMSSLKPEDTAVYYCNLWPPRASPGGRVYWGQGTQVTVSS

3PE47:

(SEQ ID NO: 58)

QVQLQESGGGLVQPGGSLRLSCAASGSTFSINAVAWYRQAPGKRRELVAGISGGGVTNYPDSVKGRFTISRDNAKNT
VYLQMSSLIPEDTAVYYCNLWPPRASPGGRVYWGQGTQVTVSS

3PE49:

(SEQ ID NO: 59)

QVQLQESGGGLVQPGGSLRLSCAGSGSTFSINAMAWYRQAPGERRELVAGISGDNITNYPNSVKGRFTISRDNAKNTV
YLQMSSLKPEDTAVYYCNLWPPRASPGGRVYWGQGTQVTVSS

3PE57:

(SEQ ID NO: 60)

QVQLQESGGGLVQPGGSLRLSCAASGSTFSVNAVAWYRQAPGKRRELVAGISGGGVTNYPDSVKGRFTISRDNAKNT
VYLQMSSLKPEDTAVYYCNLWPPRASPDGRVYWGQGTQVTVSS

3PE62:

(SEQ ID NO: 61)

QVQLQESGGGLVQPGGSLRLSCAASGSTFSSNAMAWYRQAPGKRRELVAGISGGGVTNYPDSVKGRFTISRDNAKN
TVYLQMSSLKPEDTAVYYCNLWPPRASPDGGVYWGQGTQVTVSS

3PE69:

(SEQ ID NO: 62)

QVQLQESGGGLVQPGGSLTLSCTTSEFTLAYFGVGWFRQAPGKRRDWVAGITTDGITKYPDSLKGRFTISRDNAKNTV
YLQMNSLKPEDTAVYYCNLWPPRASPSGRLYWGQGTQVTVSS

3PE72:

(SEQ ID NO: 63)

QVQLQESGGGLVQAGGSLRLSCAASGSTFSGNAMAWYRRAPGKRRELVAGISGGGVTNYPDSVKGRFTISRDNAKN
TVYLQMSSLKPEDTAVYYCNLWPPRVSPGGRVYWGQGTQVTVSS

3PE77:

(SEQ ID NO: 64)

QVQLQESGGGLVQPGGSLRLSCADSGSTFTINAMAWYRQAPGKRRELVAGISGGVTNYPDSVKGRFTISRDNAKNTV
YLQMSSLKPEDTAVYYCNLWPPRASPDGRVYWSQGTQVTVSS

3PE82:

(SEQ ID NO: 65)

QVQLQESGGGLVQPEGSLRLSCAASGSISSINAMAWYRQAPGKRRELVAGIDGGGVTNYPDSVKGRFTISRDNAKNTV
YLQMSSLKPEDTAVYYCNLWPPRASPGGRVYWGKGTQVTVSS

3PE90:

(SEQ ID NO: 66)

QVQLQESGGGLVQVGGSLRLSCAASGSTFSINAMGWYRQAPGKRREWVAGITSGVTHYPDSVKGRFTISRDNAKNTV
YLQMNSLKPEDTAVYYCNLWPPRASPSGSIYWGQGTQVTVSS

3PE92:

(SEQ ID NO: 67)

QVQLQESGGGLVQVGGSLRLSCAASGSTFSINNAMGWYRQAPGKRREVWAGISSGGVTHYPDSVKGRFTISRDNAK
NIVYLQMNSPKPEDTAVYYCNLWPPRASPSGSIYWGQGTQVTVSS

3PE93:

(SEQ ID NO: 68)

QVQLQESGGGLVQPGESLRLSCAVSGSTSSMNAMAWYRQAPGKRRELVAGISGGGATNYPDSMKGRFTISRDNAKN
TVYLQMSSLKPEDTAVYYCNLWPPRASPGGGVYWGQGTQVTVSS

-continued

3PE94:

(SEQ ID NO: 69)

QVQLQESGGGLVQPEGSLRLSCAASGSISSINAMAWYRQAPGKRRELVAGIDGGGVTNYPDSVKGRFTISRDNAKNTV
YLQMSSLKPEDTAVYYCNLWPPRASPGGRVYWGQGTQVTVSS

2PE18:

(SEQ ID NO: 70)

QVQLQESGGGLVQAGGSLRLSCADSGSTFGLSAMGWYRQTPGKQRELVASITSDGRTNYADSVKGRFTISRVNPKRT
VYLQMNSLKPDDTAVYVCNARFGIRDFWGQGTQVTVSS

2PE22:

(SEQ ID NO: 71)

QVQLQESGGGLVQPGGSLRLSCADSGSTFGLSAMGWYRQTPGKQRELVASITSDGRTNYADSVKGRFTISRVNPKRT
VYLQMNSLKPDDTAVYVCNARFGIRDFWGQGTQVTVSS

2PE26:

(SEQ ID NO: 72)

QVQLQESGGGLVQAGGSLRLSCADSGSTFGLGAMGWYRQSPGKQRELVASITSGGRTNYADSVKGRFTISRVNAKR
TVYLQMNSLKPEDTAVYVCNARFGIRDFWGQGTQVTVSS

3PE4:

(SEQ ID NO: 73)

QVQLQESGGGLVQAGGSLRLSCADSGSTFGLGAMGWYRQSPGKQRELVASITSGGRTNYSDSVKGRFTISRVNPKRI
VYLQMNSLKPEDTAVYVCNARFGIRDFWGQGTQVTVSS

3PE16:

(SEQ ID NO: 74)

QVQLQESGGGLVQAGGSLRLSCADSGSTFGLSAMGWYRLTPGKQRELVASITSDGRTNYADSVKGRFTISRVNPKRT
VYLQMNSLKPDDTAVYVCNARFGIRDFWGQGTQVTVSS

3PE22:

(SEQ ID NO: 75)

QVQLQESGGGLVQPGGSLRLSCADSGSTFGLGAMGWYRQSPGKQRELVASITSGGRTNYADSVKGRFTISRVGAKR
TVYLQMNSLKPEDTAVYVCNARFGIRDFWGQGTQVTVSS

3PE25:

(SEQ ID NO: 76)

QVQLQESGGGLVQAGGSLRLSCADSGSTFGLTAIGWYRQSPGKQRELVASITSGGRTNYADSVKGRFTISRVNPKRTV
YLQMNSLKPEDTAVYVCNARFGIRDFWGQGTQVTVSS

3PE26:

(SEQ ID NO: 77)

QVQLQESGGGLVQAGGSLRLSCADSGSTFGLGAMGWYRQSPGKQRELVASITSGGRTNYADSVKGRFTISRVGAKR
TVYLQMNSLKPEDTAVYVCNARFGIRDFWGQGTQVTVSS

3PE33:

(SEQ ID NO: 78)

QVQLQESGGGLVQAGGSLRLSCADSGSTFGLGAMGWYRQSPGKQRELVASITSGGRTNYADSVKGRFTISRENPKR
TVYLQMNSLKPEDTAVYVCNARFGIRDFWGQGTQVTVSS

3PE46:

(SEQ ID NO: 79)

QVQLQESGGGLVQAGGSLRLSCADSGSTFGLGAMGWYRQSPGKQRELVASITSGGRTNYADSVKGRFTISRVGAKR
TVYLQMNSLRPEDTAVYVCNARFGIRDFWGQGTQVTVSS

3PE55:

(SEQ ID NO: 80)

QVQLQESGGGLVQAGGSLRLSCADSGSTFGLGAMGWYRQSPGKQRELVASITSGGRTNYADSVKGRFTISRVSAKRT
VYLQMNSLKPEDTAVYVCNARFGIRDFWGQGTQVTVSS

3PE61:

(SEQ ID NO: 81)

QVQLQESGGGLVRPGGSLRLSCADSGSTFGLSAMGWYRQSPGKQRELVASIISDGRTNYADSVKGRFTISRVNAKRT
VYLQMNSLKPEDTAVYVCNARFGIRDFWGQGTQVTVSS

3PE63:

(SEQ ID NO: 82)

QVQLQESGGGLVQAGGSLRLSCADSGSTFGLSAMGWYRQSPGKQRELVASIISDGRTNYADSVKGRFTISRVNAKRT
VYLQMNSLKPEDTAVYVCNARFGIRDFWGQGTQVTVSS

3PE70:

(SEQ ID NO: 83)

QVQLQESGGGLVQAGGSLRLSCADSGSTFGLGAMGWYRQSPGKQRELVASITSGGRTNYSDSVKGRFTISRVTPKRI
VYLQMNSLKPEDTAVYVCNARFGIRDFWGQGTQVTVSS

2PE1:

(SEQ ID NO: 84)

QVQLQESGGGLVQAGGSLRLSCAASGSIFGINAVGWYRQAPGKQRELVATFTRGGDINYADSVKGRFTIFRDNAANTV
YLQMNSLKAEDTAVYYCNTPPRIGRGYWGQGTQVTVSS

-continued

2PE35:
(SEQ ID NO: 85)
QVQLQESGGGLVQVGGSLRLSCAASGSIFGINAVGWYRQAPGKQRELVATFTRGGDINYADSVKGRFTIFRDNAANTV
YLQMNSLKAEDTAVYYCNTPPRIGRGYWGQGTQVTVSS

3PE11:
(SEQ ID NO: 86)
QVQLQESGGGLVQPGGSLRLSCAASGSIFGINAVGWYRQAPGKQRELVATFTRGGDINYADSVKGRFTIFRDNAANTV
YLQMNSLKAEDTAVYYCNTPPRIGRGYWGQGTQVTVSS

By way of example, but not by way of limitation, in some embodiments, a humanized VHH FAP binding agent comprises an amino acid sequence selected from the following sequences:

• P-1901: 2PE14
(SEQ ID NO: 1045)
QVQLQESGGGLVQPGGSLRLSCAASGSTFSINAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1902: 2PE14_opt1 (Q1D_Q5V_A74S_K83R_Q108L; bold letters show the mutation)
(SEQ ID NO: 1046)
DVQLVESGGGLVQPGGSLRLSCAASGSTFSINAVAWYRQAPGKRRELVAGISGGGVTNYPDSVKGRFTISRDNSKNTV
YLQMSSLRPEDTAVYYCNLWPPRASPGGRVYWGQGTLVTVSS

• P-1903: 2PE14_opt2 (Q1D_Q5V_P60A_A74S_K83R_Q108L; bold letters show the mutation)
(SEQ ID NO: 1047)
DVQLVESGGGLVQPGGSLRLSCAASGSTFSINAVAWYRQAPGKRRELVAGISGGGVTNYADSVKGRFTISRDNSKNT
VYLQMSSLRPEDTAVYYCNLWPPRASPGGRVYWGQGTLVTVSS

• P-1904: 2PE14_opt3 (Q1D_Q5V_A74S_S82N_K83R_Q108L; bold letters show the mutation)
(SEQ ID NO: 1048)
DVQLVESGGGLVQPGGSLRLSCAASGSTFSINAVAWYRQAPGKRRELVAGISGGGVTNYPDSVKGRFTISRDNSKNTV
YLQMNSLRPEDTAVYYCNLWPPRASPGGRVYWGQGTLVTVSS

• P-1905: 2PE14_opt4 (Q1D_Q5V_P60A_A74S_S82N_K83R_Q108L; bold letters show the mutation)
(SEQ ID NO: 1049)
DVQLVESGGGLVQPGGSLRLSCAASGSTFSINAVAWYRQAPGKRRELVAGISGGGVTNYADSVKGRFTISRDNSKNT
VYLQMNSLRPEDTAVYYCNLWPPRASPGGRVYWGQGTLVTVSS

• P-1906: 2PE14_N32A (bold letters show the mutation)
(SEQ ID NO: 1050)
QVQLQESGGGLVQPGGSLRLSCAASGSTFSIAAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1907: 2PE14_N32D (bold letters show the mutation)
(SEQ ID NO: 1051)
QVQLQESGGGLVQPGGSLRLSCAASGSTFSIDAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1908: 2PE14_N32E (bold letters show the mutation)
(SEQ ID NO: 1052)
QVQLQESGGGLVQPGGSLRLSCAASGSTFSIEAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1909: 2PE14_N32F (bold letters show the mutation)
(SEQ ID NO: 1053)
QVQLQESGGGLVQPGGSLRLSCAASGSTFSIFAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1910: 2PE14_N32G (bold letters show the mutation)
(SEQ ID NO: 1054)
QVQLQESGGGLVQPGGSLRLSCAASGSTFSIGAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1911: 2PE14_N32H (bold letters show the mutation)
(SEQ ID NO: 1055)
QVQLQESGGGLVQPGGSLRLSCAASGSTFSIHAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1912: 2PE14_N32I (bold letters show the mutation)
(SEQ ID NO: 1056)
QVQLQESGGGLVQPGGSLRLSCAASGSTFSIIAVAWYRQAPGKRRELVAGISGGGVTNYPDSVKGRFTISRDNAKNTV
YLQMSSLKPEDTAVYYCNLWPPRASPGGRVYWGQGTQVTVSS -continued

• P-1913: 2PE14_N32K (bold letters show the mutation)

(SEQ ID NO: 1057)

QVQLQESGGGLVQPGGSLRLSCAASGSTFSIKAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1914: 2PE14_N32L (bold letters show the mutation)

(SEQ ID NO: 1058)

QVQLQESGGGLVQPGGSLRLSCAASGSTFSILAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1915: 2PE14_N32P (bold letters show the mutation)

(SEQ ID NO: 1059)

QVQLQESGGGLVQPGGSLRLSCAASGSTFSIPAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1916: 2PE14_N32Q (bold letters show the mutation)

(SEQ ID NO: 1060)

QVQLQESGGGLVQPGGSLRLSCAASGSTFSIQAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1917: 2PE14_N32R (bold letters show the mutation)

(SEQ ID NO: 1061)

QVQLQESGGGLVQPGGSLRLSCAASGSTFSIRAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1918: 2PE14_N32S (bold letters show the mutation)

(SEQ ID NO: 1062)

QVQLQESGGGLVQPGGSLRLSCAASGSTFSISAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1919: 2PE14_N32T (bold letters show the mutation)

(SEQ ID NO: 1063)

QVQLQESGGGLVQPGGSLRLSCAASGSTFSITAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1920: 2PE14_N32V (bold letters show the mutation)

(SEQ ID NO: 1064)

QVQLQESGGGLVQPGGSLRLSCAASGSTFSIVAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1921: 2PE14_N32W (bold letters show the mutation)

(SEQ ID NO: 1065)

QVQLQESGGGLVQPGGSLRLSCAASGSTFSIWAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1922: 2PE14_N32Y (bold letters show the mutation)

(SEQ ID NO: 1066)

QVQLQESGGGLVQPGGSLRLSCAASGSTFSIYAVAWYRQAPGKRRELVAGISGGGVTNYPDSVKGRFTISRDNAKNT
VYLQMSSLKPEDTAVYYCNLWPPRASPGGRVYWGQGTQVTVSS

• P-1923: 3PE42 (bold letters show the mutation)

(SEQ ID NO: 1067)

QVQLQESGGGLVQPGESLRLSCAVSGSTSSMNAMAWYRQAPGKRRELVAGISGGGATNYPDSVKGRFTISRDNAKN
TVYLQMSSLKPEDTAVYYCNLWPPRASPGGGVYWGQGTQVTVSS

• P-1924: 3PE42_M31A (bold letters show the mutation)

(SEQ ID NO: 1068)

QVQLQESGGGLVQPGESLRLSCAVSGSTSSANAMAWYRQAPGKRRELVAGISGGGATNYPDSVKGRFTISRDNAKN
TVYLQMSSLKPEDTAVYYCNLWPPRASPGGGVYWGQGTQVTVSS

• P-1925: 3PE42_M31D (bold letters show the mutation)

(SEQ ID NO: 1069)

QVQLQESGGGLVQPGESLRLSCAVSGSTSSDNAMAWYRQAPGKRRELVAGISGGGATNYPDSVKGRFTISRDNAKN
TVYLQMSSLKPEDTAVYYCNLWPPRASPGGGVYWGQGTQVTVSS

• P-1926: 3PE42_M31E (bold letters show the mutation)

(SEQ ID NO: 1070)

QVQLQESGGGLVQPGESLRLSCAVSGSTSSENAMAWYRQAPGKRRELVAGISGGGATNYPDSVKGRFTISRDNAKNT
VYLQMSSLKPEDTAVYYCNLWPPRASPGGGVYWGQGTQVTVSS

• P-1927: 3PE42_M31F (bold letters show the mutation)

(SEQ ID NO: 1071)

QVQLQESGGGLVQPGESLRLSCAVSGSTSSFNAMAWYRQAPGKRRELVAGISGGGATNYPDSVKGRFTISRDNAKNT
VYLQMSSLKPEDTAVYYCNLWPPRASPGGGVYWGQGTQVTVSS

• P-1928: 3PE42_M31G (bold letters show the mutation)

(SEQ ID NO: 1072)

QVQLQESGGGLVQPGESLRLSCAVSGSTSSGNAMAWYRQAPGKRRELVAGISGGGATNYPDSVKGRFTISRDNAKN
TVYLQMSSLKPEDTAVYYCNLWPPRASPGGGVYWGQGTQVTVSS

-continued

• P-1929: 3PE42_M31H (bold letters show the mutation)

(SEQ ID NO: 1073)

QVQLQESGGGLVQPGESLRLSCAVSGSTSSHNAMAWYRQAPGKRRELVAGISGGGATNYPDSVKGRFTISRDNAKN
TVYLQMSSLKPEDTAVYYCNLWPPRASPGGGVYWGQGTQVTVSS

• P-1930: 3PE42_M31I (bold letters show the mutation)

(SEQ ID NO: 1074)

QVQLQESGGGLVQPGESLRLSCAVSGSTSSINAMAWYRQAPGKRRELVAGISGGGATNYPDSVKGRFTISRDNAKNT
VYLQMSSLKPEDTAVYYCNLWPPRASPGGGVYWGQGTQVTVSS

• P-1931: 3PE42_M31K (bold letters show the mutation)

(SEQ ID NO: 1075)

QVQLQESGGGLVQPGESLRLSCAVSGSTSSKNAMAWYRQAPGKRRELVAGISGGGATNYPDSVKGRFTISRDNAKN
TVYLQMSSLKPEDTAVYYCNLWPPRASPGGGVYWGQGTQVTVSS

• P-1932: 3PE42_M31L (bold letters show the mutation)

(SEQ ID NO: 1076)

QVQLQESGGGLVQPGESLRLSCAVSGSTSSLNAMAWYRQAPGKRRELVAGISGGGATNYPDSVKGRFTISRDNAKNT
VYLQMSSLKPEDTAVYYCNLWPPRASPGGGVYWGQGTQVTVSS

• P-1933: 3PE42_M31N (bold letters show the mutation)

(SEQ ID NO: 1077)

QVQLQESGGGLVQPGESLRLSCAVSGSTSSNNAMAWYRQAPGKRRELVAGISGGGATNYPDSVKGRFTISRDNAKN
TVYLQMSSLKPEDTAVYYCNLWPPRASPGGGVYWGQGTQVTVSS

• P-1934: 3PE42_M31P (bold letters show the mutation)

(SEQ ID NO: 1078)

QVQLQESGGGLVQPGESLRLSCAVSGSTSSPNAMAWYRQAPGKRRELVAGISGGGATNYPDSVKGRFTISRDNAKNT
VYLQMSSLKPEDTAVYYCNLWPPRASPGGGVYWGQGTQVTVSS

• P-1935: 3PE42_M31Q (bold letters show the mutation)

(SEQ ID NO: 1079)

QVQLQESGGGLVQPGESLRLSCAVSGSTSSQNAMAWYRQAPGKRRELVAGISGGGATNYPDSVKGRFTISRDNAKN
TVYLQMSSLKPEDTAVYYCNLWPPRASPGGGVYWGQGTQVTVSS

• P-1936: 3PE42_M31R (bold letters show the mutation)

(SEQ ID NO: 1080)

QVQLQESGGGLVQPGESLRLSCAVSGSTSSRNAMAWYRQAPGKRRELVAGISGGGATNYPDSVKGRFTISRDNAKN
TVYLQMSSLKPEDTAVYYCNLWPPRASPGGGVYWGQGTQVTVSS

• P-1937: 3PE42_M31S (bold letters show the mutation)

(SEQ ID NO: 1081)

QVQLQESGGGLVQPGESLRLSCAVSGSTSSSNAMAWYRQAPGKRRELVAGISGGGATNYPDSVKGRFTISRDNAKNT
VYLQMSSLKPEDTAVYYCNLWPPRASPGGGVYWGQGTQVTVSS

• P-1938: 3PE42_M31T (bold letters show the mutation)

(SEQ ID NO: 1082)

QVQLQESGGGLVQPGESLRLSCAVSGSTSSTNAMAWYRQAPGKRRELVAGISGGGATNYPDSVKGRFTISRDNAKNT
VYLQMSSLKPEDTAVYYCNLWPPRASPGGGVYWGQGTQVTVSS

• P-1939: 3PE42_M31V (bold letters show the mutation)

(SEQ ID NO: 1083)

QVQLQESGGGLVQPGESLRLSCAVSGSTSSVNAMAWYRQAPGKRRELVAGISGGGATNYPDSVKGRFTISRDNAKNT
VYLQMSSLKPEDTAVYYCNLWPPRASPGGGVYWGQGTQVTVSS

• P-1940: 3PE42_M31W (bold letters show the mutation)

(SEQ ID NO: 1084)

QVQLQESGGGLVQPGESLRLSCAVSGSTSSWNAMAWYRQAPGKRRELVAGISGGGATNYPDSVKGRFTISRDNAKN
TVYLQMSSLKPEDTAVYYCNLWPPRASPGGGVYWGQGTQVTVSS

• P-1941: 3PE42_M31Y (bold letters show the mutation)

(SEQ ID NO: 1085)

QVQLQESGGGLVQPGESLRLSCAVSGSTSSYNAMAWYRQAPGKRRELVAGISGGGATNYPDSVKGRFTISRDNAKNT
VYLQMSSLKPEDTAVYYCNLWPPRASPGGGVYWGQGTQVTVSS

• P-2219: 2PE14_OptA (Q1D_Q5V_N32W_A74S_K83R_Q108L)

(SEQ ID NO: 1086)

DVQLVESGGGLVQPGGSLRLSCAASGSTFSIWAVAWYRQAPGKRRELVAGISGGGVTNYPDSVKGRFTISRDNSKNTVYL
QMSSLRPEDTAVYYCNLWPPRASPGGRVYWGQGTLVTVSS

• P-2220: 2PE14_OptB (Q1D_Q5V_N32W_A74S_S82N_K83R_Q108L)

(SEQ ID NO: 1087)

DVQLVESGGGLVQPGGSLRLSCAASGSTFSIWAVAWYRQAPGKRRELVAGISGGGVTNYPDSVKGRFTISRDNSKNTVYL
QMNSLRPEDTAVYYCNLWPPRASPGGRVYWGQGTLVTVSS

• P-1923: 3PE42

(SEQ ID NO: 1088)

QVQLQESGGGLVQPGESLRLSCAVSGSTSSMNAMAWYRQAPGKRRELVAGISGGGATNYPDSVKGRFTISRDNAKN
TVYLQMSSLKPEDTAVYYCNLWPPRASPGGGVYWGQGTQVTVSSHHHHHH

-continued

• P-2221: 3PE42_OptA (Q1D_Q5V_M31A_N32W_A74S_K83R_Q108L)

(SEQ ID NO: 1089)

DVQLVESGGGLVQPGGSLRLSCAASGSTSSAWAMAWYRQAPGKRRELVAGISGGGATNYPDSVKGRFTISRDNSKNTVY
LQMSSLRPEDTAVYYCNLWPPRASPGGGVYWGQGTLVTVSS

• P-2222: 3PE42_OptB (Q1D_Q5V_M31D_N32W_A74S_K83R_Q108L)

(SEQ ID NO: 1090)

DVQLVESGGGLVQPGGSLRLSCAASGSTSSDWAMAWYRQAPGKRRELVAGISGGGATNYPDSVKGRFTISRDNSKNTVY
LQMSSLRPEDTAVYYCNLWPPRASPGGGVYWGQGTLVTVSS

• P-2223: 3PE42_OptC (Q1D_Q5V_M31A_N32W_A74S_S82N_K83R_Q108L)

(SEQ ID NO: 1091)

DVQLVESGGGLVQPGGSLRLSCAASGSTSSAWAMAWYRQAPGKRRELVAGISGGGATNYPDSVKGRFTISRDNSKNTVY
LQMNSLRPEDTAVYYCNLWPPRASPGGGVYWGQGTLVTVSS

• P-2224: 3PE42_OptD (Q1D_Q5V_M31D_N32W_A74S_S82N_K83R_Q108L)

(SEQ ID NO: 1092)

DVQLVESGGGLVQPGGSLRLSCAASGSTSSDWAMAWYRQAPGKRRELVAGISGGGATNYPDSVKGRFTISRDNSKNTVY
LQMNSLRPEDTAVYYCNLWPPRASPGGGVYWGQGTLVTVSS

In some embodiments, the FAP binding agent comprises a targeting moiety which is a VHH comprising a single amino acid chain having four "framework regions" or FRs and three "complementary determining regions" or CDRs. As used herein, "framework region" or "FR" refers to a region in the variable domain that is located between the CDRs. As used herein, "complementary determining region" or "CDR" refers to variable regions in VHHs that contains the amino acid sequences capable of specifically binding to antigenic targets.

In some embodiments, the FAP binding agent comprises a VHH having a variable domain comprising at least one CDR1, CDR2, and/or CDR3 sequences. In some embodiments, the FAP binding agent comprises a VHH having a variable region comprising at least one FR1, FR2, FR3, and FR4 sequences.

In some embodiments, a human FAP binding agent comprises a CDR1 sequence selected from:

(SEQ ID NO: 87)

ATISSMNSMA;

(SEQ ID NO: 88)

EFTLAYFGVG;

(SEQ ID NO: 89)

ESTFSINAVA;

(SEQ ID NO: 90)

GFIFRSTSMG;

(SEQ ID NO: 91)

GGIFTIGPLG;

(SEQ ID NO: 92)

GRDFRDNSMG;

(SEQ ID NO: 93)

GSIFGINAVG;

(SEQ ID NO: 94)

GSIFSLNAMA;

(SEQ ID NO: 95)

GSIFSMG;

(SEQ ID NO: 96)

GSIFSTNAMA;

(SEQ ID NO: 97)

GSISSINAMA;

-continued (SEQ ID NO: 98)

GSISSLNAMG;

(SEQ ID NO: 99)

GSISSRNAMG;

(SEQ ID NO: 100)

GSSFIINAMG;

(SEQ ID NO: 101)

GSTARLDAMG;

(SEQ ID NO: 102)

GSTFGLGAMG;

(SEQ ID NO: 103)

GSTFGLSAMG;

(SEQ ID NO: 104)

GSTFGLTAIG;

(SEQ ID NO: 105)

GSTFILNAMA;

(SEQ ID NO: 106)

GSTFILNAMG;

(SEQ ID NO: 107)

GSTFSGNAMA;

(SEQ ID NO: 108)

GSTFSINAMA;

(SEQ ID NO: 109)

GSTFSINAMG;

(SEQ ID NO: 110)

GSTFSINAMM;

(SEQ ID NO: 111)

GSTFSINAVA;

(SEQ ID NO: 112)

GSTFSINNAMG;

(SEQ ID NO: 113)

GSTFSINSMG;

(SEQ ID NO: 114)

GSTFSSNAMA;

(SEQ ID NO: 115)

GSTFSVNAVA.

In some embodiments, a human FAP binding agent comprises a CDR2 sequence selected from:

(SEQ ID NO: 116)
AISSGGSTNYMSVKG;

(SEQ ID NO: 117)
AVTSGGVTNYADSVKG;

(SEQ ID NO: 118)
GIATDGRTNYAHSVKG;

(SEQ ID NO: 119)
GIDGGGVTNYPDSVKG;

(SEQ ID NO: 120)
GIDSADITDYARFVKG;

(SEQ ID NO: 121)
GIIGSHSTNYADSVKG;

(SEQ ID NO: 122)
GISGDNITNYPDSVKG;

(SEQ ID NO: 123)
GISGDNITNYPNSVKG;

(SEQ ID NO: 124)
GISGGDVTHYPDSVKG;

(SEQ ID NO: 125)
GISGGGATNYPDSMKG;

(SEQ ID NO: 126)
GISGGGATNYPDSVKG;

(SEQ ID NO: 127)
GISGGGVTNHPDSVKG;

(SEQ ID NO: 128)
GISGGGVTNYPDSVKG;

(SEQ ID NO: 129)
GISGGGVTNYPDSVRG;

(SEQ ID NO: 130)
GISGGGVTSYPDSVKG;

(SEQ ID NO: 131)
GISGGITTYPDSVKG;

(SEQ ID NO: 132)
GISGGSVTNYPDSVKG;

(SEQ ID NO: 133)
GISGGVTNYPDSVKG;

(SEQ ID NO: 134)
GISSDDITYYPDSVKG;

(SEQ ID NO: 135)
GISSDGATHYPDSVKG;

(SEQ ID NO: 136)
GISSGGDTNYPDSVKG;

(SEQ ID NO: 137)
GISSGGVTHYPDSVKG;

(SEQ ID NO: 138)
GISSSGPPHYPDSVKG;

(SEQ ID NO: 139)
GITSDGITNYADSVKG;

(SEQ ID NO: 140)
GITSDGLGNYVDFVKG;

(SEQ ID NO: 141)
GITSDGLGNYVGFAKG;

-continued (SEQ ID NO: 142)
GITSDGVTKYPDSVKG;

(SEQ ID NO: 143)
GITSDGVTNYPDSVKG;

(SEQ ID NO: 144)
GITSDSVTKYPDSVKG.

In some embodiments, a human FAP binding agent comprises a CDR3 sequence selected from:

(SEQ ID NO: 145)
AAVVTAKGMGAIQSRGY;

(SEQ ID NO: 146)
ADSSRGKIYFSNYRSWNY;

(SEQ ID NO: 147)
ARFGIRDF;

(SEQ ID NO: 148)
FWPPLYGRP;

(SEQ ID NO: 149)
FWPPPSDRPI;

(SEQ ID NO: 150)
FWPPPSGRPI;

(SEQ ID NO: 151)
KWPPSVPPN;

(SEQ ID NO: 152)
LWPPMASPSGAIY;

(SEQ ID NO: 153)
LWPPRAPPDGRVY;

(SEQ ID NO: 154)
LWPPRAPPGGRVY;

(SEQ ID NO: 155)
LWPPRASPDGGVY;

(SEQ ID NO: 156)
LWPPRASPDGRVY;

(SEQ ID NO: 157)
LWPPRASPGGGVY;

(SEQ ID NO: 158)
LWPPRASPGGLVY;

(SEQ ID NO: 159)
LWPPRASPGGRVY;

(SEQ ID NO: 160)
LWPPRASPSGAVY;

(SEQ ID NO: 161)
LWPPRASPSGRGY;

(SEQ ID NO: 162)
LWPPRASPSGRID;

(SEQ ID NO: 163)
LWPPRASPSGRIY;

(SEQ ID NO: 164)
LWPPRASPSGRLY;

(SEQ ID NO: 165)
LWPPRASPSGRPY;

(SEQ ID NO: 166)
LWPPRASPSGRVY;

-continued (SEQ ID NO: 167)
LWPPRASPSGSIY;

(SEQ ID NO: 168)
LWPPRASPSGTIY;

(SEQ ID NO: 169)
LWPPRVSPGGGVY;

(SEQ ID NO: 170)
LWPPRVSPGGRVY;

(SEQ ID NO: 171)
LWPPRVSPSGRGY;

-continued (SEQ ID NO: 172)
LWPPRVSPSGRIY;

(SEQ ID NO: 173)
LYPPASSGR;

(SEQ ID NO: 174)
MYRPGTYDY;

(SEQ ID NO: 175)
QWPPRALDA.

By way of example, but not by way of limitation, in some embodiments, a human VHH FAP binding agent comprises an amino acid sequence selected from the following sequences:

```
2PE48:
                                                                (SEQ ID NO: 837)
QVQLQESGGGLVQPGGSLRLSCAVSGTMLSRNAMGWYRQAPGKPRQWAGITSDGLGNYVGFAKGRFTISRDNAKN
TVYLQMNTLKPDDTAVYHCNFWPPPSGRPIWGQGTQVTVSS

3PE60:
                                                                (SEQ ID NO: 838)
QVQLQESGGGLVQPGGSLRLSCAVSGTMLSRNAMGWYRQAPGKQRQVWAGITSDGLGNYVDFVKGRFTISRDNAR
NTVYLQMNTLKPDDTAVYYCNFWPPPSDRPIWGQGTQVTVSS

2PE34:
                                                                (SEQ ID NO: 839)
QVQLQESGGGLVQAGGSLRLSCAVSGSTARLDAMGWYRQAPGKQREWVAGIDSADITDYARFVKGRFTISRDNAKNT
VYLQMNSLKPEDTAVYYCNKWPPSVPPNWGHGTQVTVSS

3PE80:
                                                                (SEQ ID NO: 840)
QVQLQESGGGLVQAGGSLRLSCAVSGSTARLDAMGWYRQAPGKQREWVAGIDSADITDYARFVKGRFTISRDNAKNT
VYLQMNSLKPEDTAVYYCNKWPPSVPPNWGQGTQVTVSS

2PE54:
                                                                (SEQ ID NO: 841)
QVQLQESGGGLVQAGGSLRLSCVHSGGIFTIGPLGWYRQAPGSQRELVATVTNGGGTYYADSVKGRFTISRDNAKNT
VYLQMNSLKPEDTAVYYCNAAWTAKGMGAIQSRGYWGQGTQVTVSS

3PE81:
                                                                (SEQ ID NO: 842)
QVQLQESGGGLVQAGGSLRLSCAHSGGIFTIGPLGWYRQAPGSQRELVATVTNGGGTYYADSVKGRFTISRDNAKNT
VYLQMNSLKPEDTAVYYCNAAWTAKGMGAIQSRGYWGQGTQVTVSS

2PE10:
                                                                (SEQ ID NO: 843)
QVQLQESGGGLVQAGGSLRLSCAASGSTFSINAMMWYRQAPGKQRELVASIGSGGNTYYADSVKGRFTISRDNGKST
LYLQMNSLKPEDTAVYYCKMYRPGTYDYWGQGTQVTVSS

3PE66:
                                                                (SEQ ID NO: 844)
QVQLQESGGGWVQPGGSLRLSCAASGSTFSINAMMWYRQAPGKQRELVASIGSGGNTYYADSVKGRFTISRDNGKS
TLYLQMNSLKPEDTAVYYCKMYRPGTYDYWGQGTQVTVSS

2PE31:
                                                                (SEQ ID NO: 845)
QVQLQESGGGLVQAGGSLSVSCAASGSIFSMGWFRQAPGKQRELVAAVTSGGVTNYADSVKGRFTISRDNAKNTVYL
QMKSLKPEDTAVYYCAADSSRGKIYFSNYRSWNYWGQGTQVTVSS

2PE79:
                                                                (SEQ ID NO: 846)
QVQLQESGGGLVQAGESLRLSCAVSATISSMNSMAWYRQAPGKQREWVAGLETGGRANYVDSVKGRFTISRDNARN
TVLLQMNSLKPEDTAVYYCNRWPPLRSSWGQGTQVTVSS

2PE91:
                                                                (SEQ ID NO: 847)
QVQLQESGGGLVQPGESLRLSCAASGSISSRNAMGWYRQAPGKEREVWAGITSDGITNYADSVKGRFTISRDNAKNT
VGLQMNSLKPDDTAVYYCNFWPPLYGRPWGQGTQVTVSS

3PE38:
                                                                (SEQ ID NO: 848)
QVQLQESGGGLVQPGGSLRLSCAASGFIFRSTSMGWYRQAPGKQREFVAGIIGSHSTNYADSVKGRFTISRDNAQNA
VYLHMNTLKPEDTAVYYCNLYPPASSGRWGKGTQVTVSS
```

-continued

2PE57:

(SEQ ID NO: 849)

QVQLQESGGGLVQAGGSLRLSCAASLKISSINAMAWYRQAAGKQRELVAGIATDGRTNYAHSVKGRFTISRDNAKNTV
YLQMNSLKPEDTAVYYCNQWPPRALDAWGQGTQVTVSS

3PE15:

(SEQ ID NO: 850)

QVQLQESGGGLVQPGGSLRLSCAASGVTFGIGAMGWYRQTPENERELVAAISSGGSTNYAASVKGRFTISRDNAPNT
VYLQMNSLKPEDTAIYYCNVRRGLAWYPGWGQGTQVTVSS

In some embodiments, the FAP binding agent comprises a VHH having a variable domain comprising at least one CDR1, CDR2, and/or CDR3 sequences. In some embodiments, the FAP binding agent comprises a VHH having a variable region comprising at least one FR1, FR2, FR3, and FR4 sequences.

In some embodiments, a human FAP binding agent comprises a CDR1 sequence selected from:

(SEQ ID NO: 851)

GSTFSVNAVG;

(SEQ ID NO: 852)

GSTFTINAMA;

(SEQ ID NO: 853)

GSTFTINAMG;

(SEQ ID NO: 854)

GSTSSINAMA;

(SEQ ID NO: 855)

GSTSSMNAMA;

(SEQ ID NO: 856)

GTMLSRNAMG;

(SEQ ID NO: 857)

GVELSRSAMA;

(SEQ ID NO: 858)

GVTFGIGAMG;

(SEQ ID NO: 859)

LKISSINAMA;

(SEQ ID NO: 860)

SGSTFSINAMA;

(SEQ ID NO: 861)

VNIVNLNSVG.

In some embodiments, a human FAP binding agent comprises a CDR2 sequence selected from:

(SEQ ID NO: 862)

GITSGGSTNYADSVKG;

(SEQ ID NO: 863)

GITSGVTHYPDSVKG;

(SEQ ID NO: 864)

GITSSGVTKYPDSVKG;

(SEQ ID NO: 865)

GITSSGVTNYPDSVKG;

(SEQ ID NO: 866)

GITSSGVTQYPDSVKG;

(SEQ ID NO: 867)

GITTDGITKYPDSLKG;

-continued (SEQ ID NO: 868)

GLETGGRANYVDSVKG;

(SEQ ID NO: 869)

SIGSGGNTYYADSVKG;

(SEQ ID NO: 870)

SHSDGRTNYADSVKG;

(SEQ ID NO: 871)

SITSAGSTNYAESVKG;

(SEQ ID NO: 872)

SITSDGRTNYADSVKG;

(SEQ ID NO: 873)

SITSGGRTNYADSVKG;

(SEQ ID NO: 874)

SITSGGRTNYSDSVKG;

(SEQ ID NO: 875)

TFTRGGDINYADSVKG;

(SEQ ID NO: 876)

TVTNGGGTYYADSVKG.

In some embodiments, a human FAP binding agent comprises a CDR3 sequence selected from:

(SEQ ID NO: 877)

RWPPLRSS;

(SEQ ID NO: 878)

TPPRIGRGY;

(SEQ ID NO: 879)

VRRGLAWYPG.

In some embodiments, a human FAP binding agent comprises a CDR1 sequence selected from:

(SEQ ID NO: 1093)

GSTFSIAAVA;

(SEQ ID NO: 1094)

GSTFSIDAVA;

(SEQ ID NO: 1095)

GSTFSIEAVA;

(SEQ ID NO: 1096)

GSTFSIFAVA;

(SEQ ID NO: 1097)

GSTFSIGAVA;

(SEQ ID NO: 1098)

GSTFSIHAVA;

(SEQ ID NO: 1099)

GSTFSIIAVA;

-continued

```
                                   (SEQ ID NO: 1100)
GSTFSIKAVA;

(SEQ ID NO: 1101)
GSTFSILAVA;

(SEQ ID NO: 1102)
GSTFSIPAVA;

(SEQ ID NO: 1103)
GSTFSIQAVA;

(SEQ ID NO: 1104)
GSTFSIRAVA;

(SEQ ID NO: 1105)
GSTFSISAVA;

(SEQ ID NO: 1106)
GSTFSITAVA;

(SEQ ID NO: 1107)
GSTFSIVAVA;

(SEQ ID NO: 1108)
GSTFSIWAVA;

(SEQ ID NO: 1109)
GSTFSIYAVA;

(SEQ ID NO: 1110)
GSTSSANAMA;

(SEQ ID NO: 1111)
GSTSSDNAMA;

(SEQ ID NO: 1112)
GSTSSENAMA;

(SEQ ID NO: 1113)
GSTSSFNAMA;

(SEQ ID NO: 1114)
GSTSSGNAMA;

(SEQ ID NO: 1115)
GSTSSHNAMA;

(SEQ ID NO: 1116)
GSTSSINAMA;

(SEQ ID NO: 1117)
GSTSSKNAMA;

(SEQ ID NO: 1118)
GSTSSLNAMA;

(SEQ ID NO: 1119)
GSTSSNNAMA;

(SEQ ID NO: 1120)
GSTSSPNAMA;

(SEQ ID NO: 1121)
GSTSSQNAMA;

(SEQ ID NO: 1122)
GSTSSRNAMA;

(SEQ ID NO: 1123)
GSTSSSNAMA;

(SEQ ID NO: 1124)
GSTSSTNAMA;

(SEQ ID NO: 1125)
GSTSSVNAMA;

(SEQ ID NO: 1126)
GSTSSWNAMA;
```

-continued

```
                                   (SEQ ID NO: 1127)
GSTSSYNAMA;

(SEQ ID NO: 1128)
GSTSSAWAMA;

(SEQ ID NO: 1129)
GSTSSDWAMA
```

In some embodiments, the FAP binding agent of the present invention is a human FAP antibody (e.g., NI-206.82C2, NI-206.59B4, NI-206.22F7, NI-206.27E8, NI-206.12G4) or a portion thereof (such as, VH chain, VL chain, CDR1, CDR2 or CDR3) as described in International Patent Publication No. WO 2016/110598 (which is hereby incorporated by reference in its entirety) wherein the amino acid sequences of VH chains, VL chains and their CDRs are as follows:

FAP Binding Agent NI-206.82C2

```
NI-206.82C2 VH:
                                   (SEQ ID NO: 880)
QVQLQQSGPGLVKPSQTLSLTCAISGDSVSSNSVTWNWIRQSPSRGLEW

LGRTYYRSKWYNDYAVSVKGRITINPDTSKNQFYLQLKSVTPEDAAVYY

CARDSSILYGDYWGQGTLVTVSS

NI-206.82C2 VL:
                                   (SEQ ID NO: 881)
QAVLTQPSSLSASPGASASLTCTLPSGINVGTYRIFWFQQKPGSPPQYL

LSYKSDSDNHQGSGVPSRFSGSKDASANAGILLISGLQSEDEADYYCMI

WHSSAWVFGGGTKLTVL
```

The FAP binding agent of the present invention may include CDR1, CDR2, or CDR3 of the VH or VL chain of NI-206.8202. The VH chain of NI-206.82C2 includes the following CDRs:

```
                                   (SEQ ID NO: 882)
         CDR1:          GDSVSSNSVTWN (SEQ ID NO: 883)
         CDR2:          RTYYRSKWYND (SEQ ID NO: 884)
         CDR3:          DSSILYGDY
```

The VL chain of NI-206.82C2 includes the following CDRs:

```
                                   (SEQ ID NO: 915)
         CDR1:          TLPSGINVGTYRIF (SEQ ID NO: 916)
         CDR2:          KSDSDNH (SEQ ID NO: 917)
         CDR3:          MIWHSSAWV
```

FAP Binding Agent NI-206.59B4

```
NI-206.59B4 VH:
                                   (SEQ ID NO: 918)
QVQLVQSGAEVKKPGASVKVSCKTSGYTFTDYYIHWRQAPGQGLEWMGW

INPNRGGTNYAQKFQGRVTMTRDTSIATAYMELSRLRSDDTAVYYCATA

SLKIAAVGTFDCWGQGTLVTVSS
```

-continued

NI-206.59B4 VL:

```
                                     (SEQ ID NO: 919)
SYELTQPPSVSVSPGQTARITCSGDALSKQYAFWFQQKPGQAPILVIYQ

DTKRPSGIPGRFSGSSSGTTVTLTISGAQADDEADYYCQSADSSGTYVF

GTGTKVTVL
```

The FAP binding agent of the present invention may include CDR1, CDR2, or CDR3 of the VH or VL chain of NI-206.59B4. The VH chain of NI-206.59B4 includes the following CDRs:

```
                                     (SEQ ID NO: 920)
CDR1:           GYTFTDYYIH (SEQ ID NO: 921)
CDR2:           WINPNRGGTN (SEQ ID NO: 922)
CDR3:           ASLKIAAVGTFDC
```

The VL chain of NI-206.82C2 includes the following CDRs:

```
                                     (SEQ ID NO: 923)
CDR1:           SGDALSKQYAF (SEQ ID NO: 924)
CDR2:           QDTKRPS (SEQ ID NO: 925)
CDR3:           QSADSSGTYV
```

FAP Binding Agent NI-206.22F7

NI-206.22F7 VH:
```
                                     (SEQ ID NO: 926)
EVQLVETGGGWQPGRSLRLSCAASGFSFSTHGMYWRQPPGKGLEWVAVI

SYDGSDKKYADSVKGRFTISRDNSKNTVYLEMSSVRAEDTALYYCFCRR

DAFDLWGQGTMVTVSS
```

NI-206.22F7 VL:
```
              (SEQ ID NO: 927)
SYVLTQPPSVSVSPGQTARITCSGDALPKKYAYWYQQKSGQAPVLVIYE

DTKRPSGIPERFSGSSSGTMATLTISGAQVEDEADYYCYSTDSSGNYWV

FGGGTEVTVL
```

The FAP binding agent of the present invention may include CDR1, CDR2, or CDR3 of the VH or VL chain of NI-206.22F7. The VH chain of NI-206.22F7 includes the following CDRs:

```
                                     (SEQ ID NO: 928)
CDR1:           GFSFSTHGMY (SEQ ID NO: 929)
CDR2:           VISYDGSDKK (SEQ ID NO: 930)
CDR3:           RRDAFDL
```

The VL chain of NI-206.22F7 includes the following CDRs:

```
                                     (SEQ ID NO: 931)
CDR1:           SGDALPKKYAY (SEQ ID NO: 932)
CDR2:           EDTKRPS (SEQ ID NO: 933)
CDR3:           YSTDSSGNYWW
```

FAP Binding Agent NI-206.27E8

NI-206.27E8 VH:
```
                                     (SEQ ID NO: 934)
EVQLVESGGGLVEPGGSLRLSCAASGFTFSDAWMNWVRQAPGKGLEWGR

IKTKSDGGTTDYAAPVRGRFSISRDDSKNTLFLEMNSLKTEDTAIYYCF

ITVIWSSESPLDHWGQGTLVTVSS
```

NI-206.27E8 VL:
```
                                     (SEQ ID NO: 935)
SYELTQPPSVSVSPGQTARITCSGDELPKQYAYWYQQKPGQAPVLVIYK

DRQRPSGIPERFSGSSSGTTVTLTISGVQAEDEADYYCQSAYSINTYVI

FGGGTKLTVL
```

The FAP binding agent of the present invention may include CDR1, CDR2, or CDR3 of the VH or VL chain of NI-206.27E8. The VH chain of NI-206.27E8 includes the following CDRs:

```
                                     (SEQ ID NO: 936)
CDR1:           GFTFSDAWMN (SEQ ID NO: 937)
CDR2:           RIKTKSDGGTTD (SEQ ID NO: 938)
CDR3:           TVIWSSESPLDH
```

The VL chain of NI-206.27E8 includes the following CDRs:

```
                                     (SEQ ID NO: 939)
CDR1:           SGDELPKQYAY (SEQ ID NO: 940)
CDR2:           KDRQRPS (SEQ ID NO: 941)
CDR3:           QSAYSINTYVI
```

FAP Binding Agent NI-206.12G4

NI-206.12G4 VH:
```
                                     (SEQ ID NO: 942)
EVQLVESGGGLVKPGGSLRLSCAASGFTFSDYYMSWIRQAPGKGLEWISY

ISSGSSYTNYADSVKGRFTISRDNAKKSVYLEVNGLTVEDTAVYYCARVR

YGDREMATIGGFDFWGQGTLVTVSS
```

NI-206.12G4 VL:
```
                                     (SEQ ID NO: 943)
SYELTQPPSVSVSPGQTARITCSGDALPKQYAYWYQQSPGQAPVLVIYKD

SERPSGIPERFSGSSSGTTVTLTISGVQAEDEADYYCQSADSGGTSRIFG

GGTKLTVL
```

The FAP binding agent of the present invention may include CDR1, CDR2, or CDR3 of the VH or VL chain of NI-206.12G4. The VH chain of NI-206.12G4 includes the following CDRs:

```
CDR1:
                              (SEQ ID NO: 944)
GFTFSDYYMS

CDR2:
                              (SEQ ID NO: 945)
YISSGSSYTN

CDR3:
                              (SEQ ID NO: 946)
VRYGDREMATIGGFDF
```

The VL chain of NI-206.12G4 includes the following CDRs:

```
CDR1:
                              (SEQ ID NO: 947)
SGDALPKQYAY

CDR2:
                              (SEQ ID NO: 948)
KDSERPS

CDR3:
                              (SEQ ID NO: 949)
QSADSGGTSRI
```

FAP Binding Agent NI-206.17A6

```
NI-206.17A6 VH:
                              (SEQ ID NO: 950)
QVQLQESGPGLVRSTETLSLTCLVSGDSINSHYWSWLRQSPGRGLEWIGY

IYYTGPTNYNPSLKSRVSISLGTSKDQFSLKLSSVTAADTARYYCARNKV

FWRGSDFYYYMDVWGKGTTVTVSS

NI-206.17A6 VL:
                              (SEQ ID NO: 951)
EIVLTQSPGTLSLSLGERATLSCRASQSLANNYLAWYQQKPGQAPRLLMY

DASTRATGIPDRFSGSGSGTDFTLTISRLEPEDFAVYYCQQFVTSHHMYI

FGQGTKVEIK
```

The FAP binding agent of the present invention may include CDR1, CDR2, or CDR3 of the VH or VL chain of NI-206.17A6. The VH chain of NI-206.17A6 includes the following CDRs:

```
CDR1:
                              (SEQ ID NO: 952)
GDSINSHYWS

CDR2:
                              (SEQ ID NO: 953)
YIYYTGPTN

CDR3:
                              (SEQ ID NO: 954)
NKVFWRGSDFYYYMDV
```

The VL chain of NI-206.17A6 includes the following CDRs:

```
CDR1:
                              (SEQ ID NO: 955)
RASQSLANNYLA
```

-continued

```
CDR2:
                              (SEQ ID NO: 956)
DASTRAT

CDR3:
                              (SEQ ID NO: 957)
QQFVTSHHMYI
```

In some embodiments, the FAP binding agent of the present invention is a FAP antibody (e.g., humanized F19) or a portion thereof (such as, VH chain, VL chain, CDR1, CDR2 or CDR3) from International Patent Publication No. WO 1999/057151 (which is hereby incorporated by reference in its entirety) wherein the amino acid sequences of VH chain, VL chain and their CDRs are as follows:

```
Humanized F19 VH:
                              (SEQ ID NO: 958)
QVQLVQSGAEVKKPGASVKVSCKTSRYTFTEYTIHWRQAPGQRLEWIG

GINPNNGIPNYNQKFKGRVTITVDTSASTAYMELSSLRSEDTAVYYCA

RRRIAYGYDEGHAMDYWGQGTLVTVSS

Humanized F19 VL:
                              (SEQ ID NO: 959)
DIVMTQSPDSLAVSLGERATINCKSSQSLLYSRNQKNYLAWYQQKPGQ

PPKLLIFWASTRESGVPDRFSGSGFGTDFTLTISSLQAEDVAVYYCQQ

YFSYPLTFGQGTKVEIK
```

The FAP binding agent of the present invention may include CDR1, CDR2, or CDR3 of the VH or VL chain of F19. The VH chain of F19 includes the following CDRs:

```
CDR1:
                              (SEQ ID NO: 960)
RYTFTEYTIH

CDR2:
                              (SEQ ID NO: 961)
GINPNNGIPN

CDR3:
                              (SEQ ID NO: 962)
RRIAYGYDEGHAMDY
```

The VL chain of F19 includes the following CDRs:

```
CDR1:
                              (SEQ ID NO: 963)
KSSQSLLYSRNQKNYLA

CDR2:
                              (SEQ ID NO: 964)
WASTRES

CDR3:
                              (SEQ ID NO: 965)
QQYFSYPLT
```

In some embodiments, the FAP binding agent of the present invention is a FAP antibody (e.g., MFP5 mouse, MFP5 Humanized Variant 1, and MFP5 Humanized Variant 2) or a portion thereof (such as, VH chain, VL chain, CDR1, CDR2 or CDR3) from International Patent Publication No. WO 2007/077173 (which is hereby incorporated by reference in its entirety) wherein the amino acid sequence of VH chain, VL chain and their CDRs are as follows:

FAP Binding Agent MP5 (Mouse)

```
MFP5 VH (mouse):
                              (SEQ ID NO: 966)
QVQLQQSGAELARPGASVNLSCKASGYTFTNNGINWLKQRTGQGLEWIG

EIYPRSTNTLYNEKFKGKATLTADRSSNTAYMELRSLTSEDSAVYFCAR

TLTAPFAFWGQGTLVTVSA

MFP5 VL (mouse):
                              (SEQ ID NO: 967)
QIVLTQSPAIMSASPGEKVTMTCSASSGVNFMHWYQQKSGTSPKRWIFD

TSKLASGVPARFSGSGSGTSYSLTISSMEAEDAATYYCQQWSFNPPTFG

GGTKLEIKR
```

The FAP binding agent of the present invention may include CDR1, CDR2, or CDR3 of the VH or VL chain of MFP5 (Mouse). The VH chain of MFP5 includes the following CDRs:

```
CDR1:
                              (SEQ ID NO: 968)
GYTFTNNGIN

CDR2:
                              (SEQ ID NO: 969)
EIYPRSTNTL

CDR3:
                              (SEQ ID NO: 970)
TLTAPFAF
```

The VL chain of MFP5 includes the following CDRs:

```
CDR1:
                              (SEQ ID NO: 971)
SASSGVNFMH

CDR2:
                              (SEQ ID NO: 972)
DTSKLAS

CDR3:
                              (SEQ ID NO: 973)
QQWSFNPPT
```

FAP Binding Agent MP5 (Humanized Variant 1)

```
MFP5 (Humanized Variant 1) VH:
                              (SEQ ID NO: 974)
QVQLVQSGAEVKKPGASVKVSCKASGYTFTNNGINWLRQAPGQGLEWMG

EIYPRSTNTLYAQKFQGRVTITADRSSNTAYMELSSLRSEDTAVYFCAR

TLTAPFAFWGQGTLVTVSS

MFP5 (Humanized Variant 1) VL:
                              (SEQ ID NO: 975)
QIVLTQSPATLSLSPGERATLSCSASSGVNFMHWYQQKPGQAPRRLIFD

TSKLASGIPARFSGSGSGTDYTLTISSLEPEDFAVYYCQQWSFNPPTFG

QGTKVEIKR
```

The FAP binding agent of the present invention may include CDR1, CDR2, or CDR3 of the VH or VL chain of MFP5 (Humanized Variant 1). The VH chain of MFP5 (Humanized Variant 1) includes the following CDRs:

```
CDR1:
                              (SEQ ID NO: 976)
GYTFTNNGIN

CDR2:
                              (SEQ ID NO: 977)
EIYPRSTNTL

CDR3:
                              (SEQ ID NO: 978)
TLTAPFAF
```

The VL chain of MFP5 (Humanized Variant 1) includes the following CDRs:

```
CDR1:
                              (SEQ ID NO: 979)
SASSGVNFMH

CDR2:
                              (SEQ ID NO: 980)
DTSKLAS

CDR3:
                              (SEQ ID NO: 981)
QQWSFNPPT
```

FAP Binding Agent MP5 (Humanized Variant 2)

```
MFP5 (Humanized Variant 2) VH:
                              (SEQ ID NO: 982)
QVQLVQSGAEVKKPGASVKVSCKASGYTFTNNGINWLRQAPGQGLEWMG
EIYPRSTNTLYAQKFQGRVTITADRSSNTAYMELSSLRSEDTAVYFCAR
TLTAPFAFWGQGTLVTVSS MFP5 (Humanized Variant 2) VL:
                              (SEQ ID NO: 983)
QIVLTQSPATLSLSPGERATLSCSASSGVNFMHWYQQKPGQAPKRLIFD
TSKLASGVPARFSGSGSGTDYTLTISSLEPEDFAVYYCQQWSFNPPTFG
QGTKVEIKR
```

The FAP binding agent of the present invention may include CDR1, CDR2, or CDR3 of the VH or VL chain of MFP5 (Humanized Variant 2). The VH chain of MFP5 (Humanized Variant 2) includes the following CDRs:

```
CDR1:
                              (SEQ ID NO: 984)
GYTFTNNGIN

CDR2:
                              (SEQ ID NO: 985)
EIYPRSTNTL

CDR3:
                              (SEQ ID NO: 986)
TLTAPFAF
```

The VL chain of MFP5 (Humanized Variant 2) includes the following CDRs:

```
CDR1:
                              (SEQ ID NO: 987)
SASSGVNFMH

CDR2:
                              (SEQ ID NO: 988)
DTSKLAS

CDR3:
                              (SEQ ID NO: 989)
QQWSFNPPT
```

In some embodiments, the FAP binding agent of the present invention is a FAP antibody (e.g., 4G8, 3F2, 28H1, 29B11, 14B3, and 4B9) or a portion thereof (such as, VH chain, VL chain, CDR1, CDR2 or CDR3) from International Patent Publication No. WO 2012/107417 (which is hereby incorporated by reference in its entirety) wherein the amino acid sequence of VH chain, VL chain and their CDRs are as follows:

FAP Binding Agent 4G8

```
4G8 VH:
                                    (SEQ ID NO: 990)
EVQLLESGGGLVQPGGSLRLSCAASGFTFSSYAMSWRQAPGKGLEWSAI
SGSGGSTYYADSVKGRFTISRDNSKNTLYLQMNSLRAEDTAVYYCAKGW
LGNFDYWGQGTLVTVSS

4G8 VL:
                                    (SEQ ID NO: 991)
EIVLTQSPGTLSLSPGERATLSCRASQSVSRSYLAWYQQKPGQAPRLLI
IGASTRATGIPDRFSGSGSGTDFTLTISRLEPEDFAVYYCQQGQVIPPT
FGQGTKVEIKR
```

The FAP binding agent of the present invention may include CDR1, CDR2, or CDR3 of the VH or VL chain of 4G8. The VH chain of 4G8 includes the following CDRs:

```
CDR1:
                                    (SEQ ID NO: 992)
GFTFSSYAMS

CDR2:
                                    (SEQ ID NO: 993)
AISGSGGSTY

CDR3:
                                    (SEQ ID NO: 994)
GWLGNFDY
```

The VL chain of 4G8 includes the following CDRs:

```
CDR1:
                                    (SEQ ID NO: 995)
RASQSVSRSYLA

CDR2:
                                    (SEQ ID NO: 996)
GASTRAT

CDR3:
                                    (SEQ ID NO: 997)
QQGQVIPPT
```

FAP Binding Agent 3F2

```
3F2 VH:
                                    (SEQ ID NO: 998)
EVQLLESGGGLVQPGGSLRLSCAASGFTFSSYAMSWRQAPGKGLEWSAI
SGSGGSTYYADSVKGRFTISRDNSKNTLYLQMNSLRAEDTAVYYCAKGW
FGGFNYWGQGTLVTVSS

3F2 VL:
                                    (SEQ ID NO: 999)
EIVLTQSPGTLSLSPGERATLSCRASQSVTSSYLAWYQQKPGQAPRLLI
NVGSRRATGIPDRFSGSGSGTDFTLTISRLEPEDFAVYYCQQGIMLPPT
FGQGTKVEIKR
```

The FAP binding agent of the present invention may include CDR1, CDR2, or CDR3 of the VH or VL chain of 3F2. The VH chain of 3F2 includes the following CDRs:

```
CDR1:
                                    (SEQ ID NO: 1000)
GFTFSSYAMS
```

-continued

```
CDR2:
                                    (SEQ ID NO: 1001)
AISGSGGSTY

CDR3:
                                    (SEQ ID NO: 1002)
GWFGGFNY
```

The VL chain of 3F2 includes the following CDRs:

```
CDR1:
                                    (SEQ ID NO: 1003)
RASQSVTSSYLA

CDR2:
                                    (SEQ ID NO: 1004)
VGSRRAT

CDR3:
                                    (SEQ ID NO: 1005)
QQGIMLPPT
```

FAP Binding Agent 28H1

```
28H1 VH:
                                    (SEQ ID NO: 1006)
QVQLLESGGGLVQPGGSLRLSCAASGFTFSSHAMSWRQAPGKGLEWSAIW
ASGEQYYADSVKGRFTISRDNSKNTLYLQMNSLRAEDTAVYYCAKGWLGN
FDYWGQGTLVTVSS

28H1 VL:
                                    (SEQ ID NO: 1007)
EIVLTQSPGTLSLSPGERATLSCRASQSVSRSYLAWYQQKPGQAPRLLII
GASTRATGIPDRFSGSGSGTDFTLTISRLEPEDFAVYYCQQGQVIPPTFG
QGTKVEIKR
```

The FAP binding agent of the present invention may include CDR1, CDR2, or CDR3 of the VH or VL chain of 28H1. The VH chain of 28H1 includes the following CDRs:

```
CDR1:
                                    (SEQ ID NO: 1008)
GFTFSSHAMS

CDR2:
                                    (SEQ ID NO: 1009)
AIWASGEQY

CDR3:
                                    (SEQ ID NO: 1010)
GWLGNFDY
```

The VL chain of 28H1 includes the following CDRs:

```
CDR1:
                                    (SEQ ID NO: 1011)
RASQSVSRSYLA

CDR2:
                                    (SEQ ID NO: 1012)
GASTRAT

CDR3:
                                    (SEQ ID NO: 1013)
QQGQVIPPT
```

FAP Binding Agent 29B11

```
29B11 VH:
                                    (SEQ ID NO: 1014)
EVQLLESGGGLVQPGGSLRLSCAASGFTFSSYAMSWVRQAPGKGLEW
SAIIGSGGITYYADSVKGRFTISRDNSKNTLYLQMNSLRAEDTAVYY
CAKGWFGGFNYWGQGTLVTVSS
```

-continued

```
29B11 VL:
                                    (SEQ ID NO: 1015)
EIVLTQSPGTLSLSPGERATLSCRASQSVTSSYLAWYQQKPGQAPRL
LINVGSRRATGIPDRFSGSGSGTDFTLTISRLEPEDFAVYYCQQGIM
LPPTFGQGTKVEIKR
```

The FAP binding agent of the present invention may include CDR1, CDR2, or CDR3 of the VH or VL chain of 29B11. The VH chain of 29B11 includes the following CDRs:

```
       CDR1:
                                    (SEQ ID NO: 1016)
       GFTFSSYAMS

CDR2:
                                    (SEQ ID NO: 1017)
       AIIGSGGITY

CDR3:
                                    (SEQ ID NO: 1018)
       GWFGGFNY
```

The VL chain of 29B11 includes the following CDRs:

```
       CDR1:
                                    (SEQ ID NO: 1019)
       RASQSVTSSYLA

CDR2:
                                    (SEQ ID NO: 1020)
       VGSRRAT

CDR3:
                                    (SEQ ID NO: 1021)
       QQGIMLPPT
```

FAP Binding Agent 14B3

```
14B3VH:
                                    (SEQ ID NO: 1022)
EVQLLESGGGLVQPGGSLRLSCAASGFTFSSYAMSWVRQAPGKGLEWSA
ILASGAITYYADSVKGRFTISRDNSKNTLYLQMNSLRAEDTAVYYCAKG
WFGGFNYWGQGTLVTVSS

14B3VL:
                                    (SEQ ID NO: 1023)
EIVLTQSPGTLSLSPGERATLSCRASQSVTSSYLAWYQQKPGQAPRLLI
NVGSRRATGIPDRFSGSGSGTDFTLTISRLEPEDFAVYYCQQGIMLPPT
FGQGTKVEIKR
```

The FAP binding agent of the present invention may include CDR1, CDR2, or CDR3 of the VH or VL chain of 14B3. The VH chain of 14B3 includes the following CDRs:

```
       CDR1:
                                    (SEQ ID NO: 1024)
       GFTFSSYAMS

CDR2:
                                    (SEQ ID NO: 1025)
       AILASGAITY

CDR3:
                                    (SEQ ID NO: 1026)
       GWFGGFNY
```

The VL chain of 14B3 includes the following CDRs:

```
       CDR1:
                                    (SEQ ID NO: 1027)
       RASQSVTSSYLA
```

-continued

```
       CDR2:
                                    (SEQ ID NO: 1028)
       VGSRRAT

CDR3:
                                    (SEQ ID NO: 1029)
       QQGIMLPPT
```

FAP Binding Agent 4B9

```
4B9 VH:
                                    (SEQ ID NO: 1030)
EVQLLESGGGLVQPGGSLRLSCAASGFTFSSYAMSWRQAPGKGLEWSAIIG
SGASTYYADSVKGRFTISRDNSKNTLYLQMNSLRAEDTAVYYCAKGWFGGF
NYWGQGTLVTVSS

4B9 VL:
                                    (SEQ ID NO: 1031)
EIVLTQSPGTLSLSPGERATLSCRASQSVTSSYLAWYQQKPGQAPRLLINV
GSRRATGIPDRFSGSGSGTDFTLTISRLEPEDFAVYYCQQGIMLPPTFGQG
TKVEIKR
```

The FAP binding agent of the present invention may include CDR1, CDR2, or CDR3 of the VH or VL chain of 4B9. The VH chain of 4B9 includes the following CDRs:

```
       CDR1:
                                    (SEQ ID NO: 1032)
       GFTFSSYAMS

CDR2:
                                    (SEQ ID NO: 1033)
       AIIGSGASTY

CDR3:
                                    (SEQ ID NO: 1034)
       GWFGGFNY
```

The VL chain of 4B9 includes the following CDRs:

```
       CDR1:
                                    (SEQ ID NO: 1035)
       RASQSVTSSYLA

CDR2:
                                    (SEQ ID NO: 1036)
       VGSRRAT

CDR3:
                                    (SEQ ID NO: 1037)
       QQGIMLPPT.
```

Any one of the FAP binding agents, disclosed herein, can be an antibody. A FAP binding agent that is an antibody can be a part of any one of chimeric proteins or chimeric protein complexes disclosed herein. As used herein, the term "antibody" refers to any immunoglobulin or antibody (e.g., human, hamster, feline, mouse, cartilaginous fish, or camelid antibodies), and any derivative or conjugate thereof, that specifically binds to an antigen. A wide variety of antibodies are known by those skilled in the art. Non-limiting examples of antibodies include monoclonal antibodies, polyclonal antibodies, humanized antibodies, multi-specific antibodies (e.g., bi-specific antibodies), single-chain antibodies (e.g., single-domain antibodies, camelid antibodies, and cartilaginous fish antibodies), chimeric antibodies, feline antibodies, and felinized antibodies. Monoclonal antibodies are homogeneous populations of antibodies to a particular epitope of an antigen. Polyclonal antibodies are heterogeneous populations of antibody molecules that are contained in the sera of the immunized animals. The term "antibody" also includes antibody derivatives and conjugates (e.g., an antibody conjugated to a stabilizing protein, a detectable moiety, or a therapeutic agent).

Any one of the FAP binding agents, disclosed herein, can be an antigen binding fragment of an antibody. A FAP binding agent that is an antigen binding fragment of an antibody can be a part of any one of chimeric proteins or chimeric protein complexes disclosed herein. An "antigen binding fragment" is any portion of a full-length antibody that contains at least one variable domain (e.g., a variable domain of a mammalian (e.g., feline, human, hamster, or mouse) heavy or light chain immunoglobulin, a camelid variable antigen binding domain (VHH), or a cartilaginous fish immunoglobulin new antigen receptor (Ig-NAR) domain) that is capable of specifically binding to an antigen. Non-limiting examples of antibody fragments include Fab, Fab', F(ab')$_2$, and Fv fragments, diabodies, linear antibodies, and multi-specific antibodies formed from antibody fragments. Additional antibody fragments containing at least one camelid VHH domain or at least one cartilaginous fish Ig-NAR domain include mini-bodies, micro-antibodies, sub-nano-antibodies, and nano-antibodies, and any of the other forms of antibodies described, for example, in U.S. Publication No. 2010/0092470.

Any one of the FAP binding agents, disclosed herein, can be an Fv fragment of an antibody. A FAP binding agent that is an Fv fragment of an antibody can be a part of any one of chimeric proteins or chimeric protein complexes disclosed herein. An "Fv fragment" is the minimum antibody fragment that contains a complete antigen recognition and binding site. This region consists of a dimer of one heavy chain variable domain and one light chain variable domain in tight, non-covalent association. It is in this configuration that the three complementary determining regions (CDRs) of each variable domain interact to define an antigen binding site on the surface of the VH-VL dimer.

Any one of the FAP binding agents, disclosed herein, can be a complementary determining region (CDR) of an antibody. A FAP binding agent that is a CDR of an antibody can be a part of any one of chimeric proteins or chimeric protein complexes disclosed herein. The term CDR refers to a region within an immunoglobulin (a heavy or light chain immunoglobulin) that forms part of an antigen binding site in an antibody or antigen binding fragment thereof. As is known in the art, heavy chain and light chain immunoglobulins each contain three CDRs, referred to as CDR1, CDR2, and CDR3. In any antibody or antigen binding fragment, the three CDRs from the heavy chain immunoglobulin and the three CDRs from the light chain immunoglobulin together form an antigen binding site in the antibody or antigen binding fragment thereof. The Kabat Database is one system used in the art to number CDR sequences present in a light chain immunoglobulin or a heavy chain immunoglobulin.

Collectively, the six CDR's confer antigen binding specificity to the antibody. However, even a single variable domain (or half of an Fv comprising only three CDR's specific for an antigen) has the ability to recognize and bind the antigen, although usually at a lower affinity than the entire binding site. The "Fab fragment" also contains the constant domain of the light chain and the first constant domain ($C_H1$) of the heavy chain. The "Fab fragment" differs from the "Fab' fragment" by the addition of a few residues at the carboxy terminus of the heavy chain $C_H1$ domain, including one or more cysteines from the antibody hinge region. The "F(ab')2 fragment" originally is produced as a pair of "Fab' fragments" which have hinge cysteines between them. Methods of preparing such antibody fragments, such as papain or pepsin digestion, are known to those skilled in the art. For example, F(ab')2 fragments can be produced by pepsin digestion of an antibody molecule, and Fab fragments can be generated by reducing the disulfide bridges of F(ab')2 fragments. In some cases, Fab expression libraries can be constructed. See, for example, Huse et al., *Science,* 246:1275, 1989. Once produced, antibodies or fragments thereof can be tested for recognition of a TNFRSF25 polypeptide using standard immunoassay methods such as ELISA techniques, radioimmunoassays, and Western blotting. See, *Short Protocols in Molecular Biology,* Chapter 11, Green Publishing Associates and John Wiley & Sons, Ed. Ausubel et al., 1992.

An antibody can be of the IgA-, IgD-, IgE, IgG- or IgM-type, including IgG- or IgM-types such as, without limitation, IgG1-, IgG2-, IgG3-, IgG4-, IgM1- and IgM2-types. For example, in some cases, the antibody is of the IgG1-, IgG2- or IgG4-type.

In some embodiments, antibodies as provided herein can be fully human or humanized antibodies. By "human antibody" is meant an antibody that is encoded by a nucleic acid (e.g., a rearranged human immunoglobulin heavy or light chain locus) present in the genome of a human. In some embodiments, a human antibody can be produced in a human cell culture (e.g., feline hybridoma cells). In some embodiments, a human antibody can be produced in a non-human cell (e.g., a mouse or hamster cell line). In some embodiments, a human antibody can be produced in a bacterial or yeast cell.

Human antibodies can avoid certain problems associated with xenogeneic antibodies, such as antibodies that possess murine or rat variable and/or constant regions. For example, because the effector portion is human, it can interact better with other parts of the human immune system, e.g., to destroy target cells more efficiently by complement-dependent cytotoxicity or antibody-dependent cellular cytotoxicity. In addition, the human immune system should not recognize the antibody as foreign. Further, half-life in human circulation will be similar to naturally occurring human antibodies, allowing smaller and less frequent doses to be given. Methods for preparing human antibodies are known in the art.

As used herein, the term "humanized antibody" refers to a human antibody that contains minimal sequence derived from non-human (e.g., mouse, hamster, rat, rabbit, or goat) immunoglobulin. Humanized antibodies generally are chimeric or mutant monoclonal antibodies from mouse, rat, hamster, rabbit or other species, bearing human constant and/or variable region domains or specific changes. In non-limiting examples, humanized antibodies are human antibodies (recipient antibody) in which hypervariable region (HVR) residues of the recipient antibody are replaced by HVR residues from a non-human species (donor) antibody, such as a mouse, rat, rabbit, or goat antibody having the desired specificity, affinity, and capacity. In some embodiments, Fv framework residues of the human immunoglobulin can be replaced by corresponding non-human residues. In some embodiments, humanized antibodies can contain residues that are not found in the recipient antibody or in the donor antibody. Such modifications can be made to refine antibody performance, for example.

In some embodiments, a humanized antibody can contain substantially all of at least one, and typically two, variable domains, in which all or substantially all of the hypervariable loops (CDRs) correspond to those of a non-human immunoglobulin, while all or substantially all of the framework regions are those of a human immunoglobulin sequence. A humanized antibody also can contain at least a portion of an immunoglobulin constant (Fc) region, typically that of a human immunoglobulin.

In some embodiments, a humanized antibody or antigen binding fragment as provided herein can have reduced or minimal effector function (e.g., as compared to corresponding, non-humanized antibody), such that it does not stimulate effector cell action to the same extent that a corresponding non-humanized antibody would.

Techniques for generating humanized antibodies are well known to those of skill in the art. In some embodiments, controlled rearrangement of antibody domains joined through protein disulfide bonds to form new, artificial protein molecules or "chimeric" antibodies can be utilized (Konieczny et al., *Haematologia* (*Budap.*) 14:95, 1981). Recombinant DNA technology can be used to construct gene fusions between DNA sequences encoding mouse antibody variable light and heavy chain domains and human antibody light and heavy chain constant domains (Morrison et al., *Proc Natl Acad Sci USA* 81:6851, 1984). For example, DNA sequences encoding antigen binding portions or CDRs of murine monoclonal antibodies can be grafted by molecular means into DNA sequences encoding frameworks of human antibody heavy and light chains (Jones et al., *Nature* 321: 522, 1986; and Riechmann et al., *Nature* 332:323, 1988). Expressed recombinant products are called "reshaped" or humanized antibodies, and contain the framework of a human antibody light or heavy chain and antigen recognition portions, CDRs, of a murine monoclonal antibody.

Other methods for designing heavy and light chains and for producing humanized antibodies are described in, for example, U.S. Pat. Nos. 5,530,101; 5,565,332; 5,585,089; 5,639,641; 5,693,761; 5,693,762; and 5,733,743. Yet additional methods for humanizing antibodies are described in U.S. Pat. Nos. 4,816,567; 4,935,496; 5,502,167; 5,558,864; 5,693,493; 5,698,417; 5,705,154; 5,750,078; and 5,770,403, for example.

Antibodies disclosed herein can be produced using standard methods. For example, they can be recombinantly produced, purified from a biological sample (e.g., a heterologous expression system), or chemically synthesized, and used to immunize host animals, including rabbits, chickens, mice, guinea pigs, or rats. Various adjuvants that can be used to increase the immunological response depend on the host species and include Freund's adjuvant (complete and incomplete), mineral gels such as aluminum hydroxide, surface active substances such as lysolecithin, pluronic polyols, polyanions, peptides, oil emulsions, keyhole limpet hemocyanin and dinitrophenol. Monoclonal antibodies can be prepared using, e.g., FAP and standard hybridoma technology. In particular, monoclonal antibodies can be obtained by any technique that provides for the production of antibody molecules by continuous cell lines in culture such as described by Kohler et al. (*Nature* 256:495, 1975), the human B-cell hybridoma technique of Kosbor et al. (*Immunology Today*, 4:72, 1983) or Cote et al. (*Proc. Natl. Acad. Sci. USA*, 80:2026, 1983), and the EBV-hybridoma technique described by Cole et al. (*Monoclonal Antibodies and Cancer Therapy*, Alan R. Liss, Inc., pp. 77-96, 1983). Such antibodies can be of any immunoglobulin class including IgG, IgM, IgE, IgA, IgD, and any subclass thereof. The hybridoma producing the monoclonal antibodies can be cultivated in vitro and in vivo.

In some embodiments, an antibody as provided herein has a heavy chain variable region containing any one of the VH amino acid sequences disclosed herein. In other embodiments, an antibody as provided herein has a heavy chain variable region containing any one of the VH amino acid sequences disclosed herein with one to 24 modifications (e.g., substitutions, additions, or deletions) such that the amino acid sequence has, e.g., one, two, three, four, five, six, seven, eight, nine, ten, eleven, twelve, thirteen, fourteen, fifteen, sixteen, seventeen, eighteen, nineteen, twenty, twenty-one, twenty-two, twenty-three, or twenty-four modification(s). In some embodiments, an antibody as provided herein has a light chain variable region containing any one of the VL amino acid sequences disclosed herein. In other embodiments, an antibody as provided herein has a light chain variable region containing any one of the VL amino acid sequences disclosed herein with one to 24 modifications (e.g., substitutions, additions, or deletions) such that the amino acid sequence has, e.g., one, two, three, four, five, six, seven, eight, nine, ten, eleven, twelve, thirteen, fourteen, fifteen, sixteen, seventeen, eighteen, nineteen, twenty, twenty-one, twenty-two, twenty-three, or twenty-four modification(s). This document also provides antibodies and antigen binding fragments that contain both a heavy chain variable region polypeptide and a light chain variable region polypeptide as disclosed herein. The antibodies or antigen binding fragments, as disclosed herein, also can include variable region heavy chain framework (FW) sequences juxtaposed between the CDRs, according to the formula (FW1)-(CDR1)-(FW2)-(CDR2)-(FW3)-(CDR3)-(FW4), for example. In some embodiments, the FW sequences can be human sequences.

In some embodiments, for example, the FAP binding agent has up to five modifications (substitutions, deletions, or insertions) in any one of the amino acid sequences for an antibody's CDR disclosed herein. For example, the FAP binding agent includes up to five substitutions, deletions, or insertions in any one of amino acid sequences of CDR1, CDR2, or CDR3 of an antibody disclosed herein.

In some embodiments, amino acid substitutions to the antibodies or FAP binding agents disclosed herein can be made by selecting conservative substitutions that do not differ significantly in their effect on maintaining (a) the structure of the peptide backbone in the area of the substitution, (b) the charge or hydrophobicity of the molecule at the target site, or (c) the bulk of the side chain. For example, naturally occurring residues can be divided into groups based on side-chain properties: (1) hydrophobic amino acids (norleucine, methionine, alanine, valine, leucine, and isoleucine); (2) neutral hydrophilic amino acids (cysteine, serine, and threonine); (3) acidic amino acids (aspartic acid and glutamic acid); (4) basic amino acids (asparagine, glutamine, histidine, lysine, and arginine); (5) amino acids that influence chain orientation (glycine and proline); and (6) aromatic amino acids (tryptophan, tyrosine, and phenylalanine). Substitutions made within these groups can be considered conservative substitutions. Non-limiting examples of conservative substitutions include, without limitation, substitution of valine for alanine, lysine for arginine, glutamine for asparagine, glutamic acid for aspartic acid, serine for cysteine, asparagine for glutamine, aspartic acid for glutamic acid, proline for glycine, arginine for histidine, leucine for isoleucine, isoleucine for leucine, arginine for lysine, leucine for methionine, leucine for phenylalanine, glycine for proline, threonine for serine, serine for threonine, tyrosine for tryptophan, phenylalanine for tyrosine, and/or leucine for valine. In some embodiments, an amino acid substitution can be non-conservative, such that a member of one of the amino acid classes described above is exchanged for a member of another class. In some embodiments, the FAP binding agent has at least 90% identity with any amino acid sequence selected from SEQ ID NOS: 2-42, 46-86, 837-850, 1045-1085, or 1086-1092 or of any one of the FAP binding agents disclosed herein. In some embodiments, the FAP binding agent has about 90%, about 91%, about 92%, about 93%, about 94%, about 95%, about 96%, about 97%, about 98%, about 99% identity with any amino acid selected from SEQ ID NOS: 2-42, 46-86, 837-850, 1045-1085, or 1086-1092 or of any one of the FAP binding agents disclosed herein.

In an embodiment, for example, the FAP binding agent has up to five substitutions, deletions, or insertions in any amino acid sequence selected from SEQ ID NOS: 87-175 or 851-879 or any CDR of a FAP binding agent disclosed herein. For example, the FAP binding agent includes up to five substitutions, deletions, or insertions in any amino acid sequence selected of CDR1, e.g., from SEQ ID NOS: 87-115, 851-861, 1093-1129, 882, 915, 920, 923, 928, 931, 936, 939, 944, 947, 952, 955, 960, 963, 968, 971, 976, 979, 984, 987, 992, 995, 1000, 1003, 1008, 1011, 1016, 1019, 1024, 1027, 1032, or 1035 (e.g., one, two, three, four or five total amino acid substitutions, deletions or insertions). Similarly, in another embodiment, the FAP binding agent includes up to five substitutions, deletions, or insertions in any amino acid sequence selected of CDR2, e.g., from SEQ ID NOS: 116-144, 862-876, 883, 916, 921, 924, 929, 932, 937, 940, 945, 948, 953, 956, 961, 964, 969, 972, 977, 980, 985, 988, 993, 996, 1001, 1004, 1009, 1012, 1017, 1020, 1025, 1028, 1033, or 1036 (e.g., one, two, three, four or five total amino acid substitutions, deletions or insertions). Similarly, in another embodiment, the FAP binding agent includes up to five substitutions, deletions, or insertions in any amino acid sequence selected of CDR3, e.g., from SEQ ID NOS: 145-175, 877-879, 884, 917, 922, 925, 930, 933, 938, 941, 946, 949, 954, 957, 962, 965, 970, 973, 978, 981, 986, 989, 994, 997, 1002, 1005, 1010, 1013, 1018, 1021, 1026, 1029, 1034, 1037 (e.g., one, two, three, four or five total amino acid substitutions, deletions or insertions). An amino acid substitution refers to the replacement of one or more amino acid residues with another residue(s) in a peptide sequence. An amino acid deletion refers to removal of one or more amino acid residues from a peptide sequence. An amino acid insertion refers to addition of one or more amino acid residues into a peptide sequence.

In various illustrative embodiments, the murine FAP binding agent has at least 90% identity with the amino acid sequence of sibrotuzumab.

In some embodiments, the present technology contemplates the use of any natural or synthetic analogs, mutants, variants, alleles, homologs and orthologs (herein collectively referred to as "analogs") of the FAP binding agent of the present technology as described herein. In some embodiments, the amino acid sequence of the FAP binding agent further includes an amino acid analog, an amino acid derivative, or other non-classical amino acids.

In some embodiments, the FAP binding agent comprises a targeting moiety comprising a sequence that is at least 60% identical to any one of the FAP sequences disclosed herein. For example, the FAP binding agent may comprise a targeting moiety comprising a sequence that is at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% identical to any of the FAP sequences disclosed herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, about 99% or about 100% sequence identity to any one of the sequences disclosed herein).

In some embodiments, the FAP binding agent comprises a targeting moiety comprising an amino acid sequence having one or more amino acid mutations with respect to any one of the sequences disclosed herein. In some embodiments, the FAP binding agent comprises a targeting moiety comprising an amino acid sequence having one, or two, or three, or four, or five, or six, or seen, or eight, or nine, or ten, or fifteen, or twenty amino acid mutations with respect to any one of the sequences disclosed herein.

In some embodiments, the one or more amino acid mutations may be independently selected from substitutions, insertions, deletions, and truncations.

In some embodiments, the amino acid mutations are amino acid substitutions, and may include conservative and/or non-conservative substitutions.

"Conservative substitutions" may be made, for instance, on the basis of similarity in polarity, charge, size, solubility, hydrophobicity, hydrophilicity, and/or the amphipathic nature of the amino acid residues involved. The 20 naturally occurring amino acids can be grouped into the following six standard amino acid groups: (1) hydrophobic: Met, Ala, Val, Leu, Ile; (2) neutral hydrophilic: Cys, Ser, Thr; Asn, Gln; (3) acidic: Asp, Glu; (4) basic: His, Lys, Arg; (5) residues that influence chain orientation: Gly, Pro; and (6) aromatic: Trp, Tyr, Phe.

As used herein, "conservative substitutions" are defined as exchanges of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt a-helices.

As used herein, "non-conservative substitutions" are defined as exchanges of an amino acid by another amino acid listed in a different group of the six standard amino acid groups (1) to (6) shown above.

In some embodiments, the substitutions include non-classical amino acids. Illustrative non-classical amino acids include, but are not limited to, selenocysteine, pyrrolysine, N-formylmethionine β-alanine, GABA and δ-Aminolevulinic acid, 4-aminobenzoic acid (PABA), D-isomers of the common amino acids, 2,4-diaminobutyric acid, α-amino isobutyric acid, 4-aminobutyric acid, Abu, 2-amino butyric acid, γ-Abu, ε-Ahx, 6-amino hexanoic acid, Aib, 2-amino isobutyric acid, 3-amino propionic acid, ornithine, norleucine, norvaline, hydroxyproline, sarcosme, citrulline, homocitrulline, cysteic acid, t-butylglycine, t-butylalanine, phenylglycine, cyclohexylalanine, β-alanine, fluoro-amino acids, designer amino acids such as β methyl amino acids, C α-methyl amino acids, N α-methyl amino acids, and amino acid analogs in general.

In some embodiments, one or more amino acid mutations are in the CDRs of the targeting moiety (e.g., the CDR1, CDR2 or CDR3 regions). In another embodiment, one or more amino acid mutations are in the framework regions (FRs) of the targeting moiety (e.g., the FR1, FR2, FR3, or FR4 regions).

Modification of the amino acid sequences may be achieved using any known technique in the art e.g., site-directed mutagenesis or PCR based mutagenesis. Such techniques are described, for example, in Sambrook et al., Molecular Cloning: A Laboratory Manual, Cold Spring Harbor Press, Plainview, N.Y., 1989 and Ausubel et al., Current Protocols in Molecular Biology, John Wiley & Sons, New York, N.Y., 1989.

In some embodiments, the mutations do not substantially reduce the present FAP binding agent's capability to specifically bind to FAP. In some embodiments, the mutations do not substantially reduce the present FAP binding agent's capability to specifically bind to FAP and without functionally modulating (e.g., partially or fully neutralizing) FAP.

In some embodiments, the binding affinity of the FAP binding agent of the present technology for the full-length and/or mature forms and/or isoforms and/or splice variants and/or fragments and/or monomeric and/or dimeric forms and/or any other naturally occurring or synthetic analogs, variants, or mutants (including monomeric and/or dimeric forms) of human FAP may be described by the equilibrium dissociation constant ($K_D$). In some embodiments, the FAP binding agent comprises a targeting moiety that binds to the full-length and/or mature forms and/or isoforms and/or splice variants and/or fragments and/or any other naturally occurring or synthetic analogs, variants, or mutants (including monomeric and/or dimeric forms) of human FAP with a $K_D$ of less than about 1 μM, about 900 nM, about 800 nM, about 700 nM, about 600 nM, about 500 nM, about 400 nM, about 300 nM, about 200 nM, about 100 nM, about 90 nM, about 80 nM, about 70 nM, about 60 nM, about 50 nM, about 40 nM, about 30 nM, about 20 nM, about 10 nM, or about 5 nM, or about 1 nM.

In some embodiments, the FAP binding agent comprises a targeting moiety that binds but does not functionally modulate (e.g., partially or fully neutralize) the antigen of interest, i.e., FAP. For instance, in some embodiments, the targeting moiety of the FAP binding agent simply targets the antigen but does not substantially functionally modulate (e.g. partially or fully inhibit, reduce or neutralize) a biological effect that the antigen has. In some embodiments, the targeting moiety of the FAP binding agent binds an epitope that is physically separate from an antigen site that is important for its biological activity (e.g. an antigen's active site).

Such binding without significant function modulation finds use in some embodiments of the present technology, including methods in which the present FAP binding agent is used to directly or indirectly recruit active immune cells to a site of need via an effector antigen. For example, in some embodiments, the present FAP binding agent may be used to directly or indirectly recruit dendritic cells via FAP to a tumor cell in a method of reducing or eliminating a tumor (e.g. the FAP binding agent may comprise a targeting moiety having an anti-FAP antigen recognition domain and a targeting moiety having a recognition domain (e.g. antigen recognition domain) directed against a tumor antigen or receptor). In such embodiments, it is desirable to directly or indirectly recruit dendritic cells but not to functionally modulate or neutralize the FAP activity. In these embodiments, FAP signaling is an important piece of the tumor reducing or eliminating effect.

In some embodiments, the FAP binding agent enhances antigen-presentation by dendritic cells. For example, in some embodiments, the present FAP binding agent directly or indirectly recruits dendritic cells via FAP to a tumor cell, where tumor antigens are subsequently endocytosed and presented on the dendritic cell for induction of potent humoral and cytotoxic T cell responses.

In other embodiments (for example, related to treating cancer, autoimmune, or neurodegenerative disease), the FAP binding agent comprises a targeting moiety that binds and neutralizes the antigen of interest, i.e., FAP. For instance, in some embodiments, the present methods may inhibit or reduce FAP signaling or expression, e.g. to cause a reduction in an immune response.

Chimeras and Fusions with Signaling Agents

In some embodiments, the FAP binding agent of the present technology, as disclosed herein, is part of a chimera or fusion protein or Fc-based chimeric protein complex with one or more signaling agents. Accordingly, the present technology provides for chimeric or fusion proteins or Fc-based chimeric protein complex that include, for example, a targeting moiety against FAP and one or more signaling agents. In some embodiments, the signaling agent is a wildtype signaling agent or a modified signaling agent.

In various embodiments, the chimera or fusion protein or Fc-based chimeric protein complex includes a wild type signaling agent that has improved target selectivity and safety relative to i) a signaling agent which is not fused to an Fc; or ii) a signaling agent which is not in the context of a complex, e.g., without limitation, a heterodimeric complex. In various embodiments, the chimera or fusion protein or Fc-based chimeric protein complex comprises a wild type signaling agent that has improved target selective activity relative to i) a signaling agent which is not fused to an Fc, or ii) a signaling agent which is not in the context of a complex, e.g., without limitation, a heterodimeric complex. In various embodiments, the Fc-based chimeric protein complex allows for conditional activity.

In various embodiments, the chimera or fusion protein or Fc-based chimeric protein complex comprises a wild type signaling agent that has improved safety, e.g. reduced systemic toxicity, reduced side effects, and reduced off-target effects relative to a signaling agent which is not fused to an Fc, or a signaling agent which is not in the context of a complex, e.g., without limitation, a heterodimeric complex. In various embodiments, improved safety means that the present chimera or fusion protein or Fc-based chimeric protein provides lower toxicity (e.g. systemic toxicity and/or tissue/organ-associated toxicities); and/or lessened or substantially eliminated side effects; and/or increased tolerability, lessened or substantially eliminated adverse events; and/or reduced or substantially eliminated off-target effects; and/or an increased therapeutic window of the wild type signaling agent as compared to the signaling agent which is not fused to an Fc, or a signaling agent which is not in the context of a complex, e.g., without limitation, a heterodimeric complex.

In some embodiments, the reduced affinity or activity at the receptor is restorable by attachment with one or more of the targeting moieties as described herein or upon inclusion in the Fc-based chimeric protein complex as disclosed herein.

In various embodiments, the chimera or fusion protein or Fc-based chimeric protein complex comprises a wild type signaling agent that has reduced, substantially reduced, or ablated affinity, e.g. binding (e.g. $K_D$) and/or activation (for instance, when the modified signaling agent is an agonist of its receptor, measurable as, for example, $K_A$ and/or $EC_{50}$) and/or inhibition (for instance, when the modified signaling agent is an antagonist of its receptor, measurable as, for example, $K_I$ and/or $IC_{50}$), for one or more of its receptors. In various embodiments, the reduced affinity at the signaling agent's receptor allows for attenuation of activity. In such embodiments, the modified signaling agent has about 1%, or about 3%, about 5%, about 10%, about 15%, about 20%, about 25%, about 30%, about 35%, about 40%, about 45%, about 50%, about 60%, about 65%, about 70%, about 75%, about 80%, about 85%, about 90%, about 95%, or about 10%-20%, about 20%-40%, about 50%, about 40%-60%, about 60%-80%, about 80%-100% of the affinity for the receptor as compared to the signaling agent which is not fused to an Fc, or a signaling agent which is not in the context of a complex, e.g., without limitation, a heterodimeric complex. In some embodiments, the binding affinity is at least about 2-fold lower, about 3-fold lower, about 4-fold lower, about 5-fold lower, about 6-fold lower, about 7-fold lower, about 8-fold lower, about 9-fold lower, at least about 10-fold lower, at least about 15-fold lower, at least about 20-fold lower, at least about 25-fold lower, at least about 30-fold lower, at least about 35-fold lower, at least about 40-fold lower, at least about 45-fold lower, at least about 50-fold lower, at least about 100-fold lower, at least about 150-fold lower, or about 10-50-fold lower, about 50-100-fold lower, about 100-150-fold lower, about 150-200-fold lower, or more than 200-fold lower as compared to the signaling agent which is not fused to an Fc, or a signaling agent which is not in the context of a complex, e.g., without limitation, a heterodimeric complex.

In various embodiments, the chimera or fusion protein or Fc-based chimeric protein complex comprises a wild type signaling agent that has reduced endogenous activity of the signaling agent to about 75%, or about 70%, or about 60%, or about 50%, or about 40%, or about 30%, or about 25%, or about 20%, or about 10%, or about 5%, or about 3%, or about 1%, e.g., as compared to the signaling agent which is not fused to an Fc, or a signaling agent which is not in the context of a complex, e.g., without limitation, a heterodimeric complex.

In some embodiments, the signaling agent is modified to have reduced affinity or activity for one or more of its receptors, which allows for attenuation of activity (inclusive of agonism or antagonism) and/or prevents non-specific signaling or undesirable sequestration of the chimeric or fusion protein or Fc-based chimeric protein complex. In some embodiments, the signaling agent is antagonistic in its wild type form and bears one or more mutations that attenuate its antagonistic activity. In some embodiments, the signaling agent is antagonistic due to one or more mutations, e.g. an agonistic signaling agent is converted to an antagonistic signaling agent and, such a converted signaling agent, optionally, also bears one or more mutations that attenuate its antagonistic activity (e.g. as described in WO 2015/007520, the entire contents of which are hereby incorporated by reference).

Accordingly, in some embodiments, the signaling agent is a modified (e.g. mutant) form of the signaling agent having one or more modifications (e.g. mutations). In some embodiments, the mutations allow for the modified signaling agent to have one or more of attenuated activity such as one or more of reduced binding affinity, reduced endogenous activity, and reduced specific bioactivity relative to unmutated, i.e., the wild type form of the signaling agent (e.g. comparing the same signaling agent in a wild type form versus a modified (e.g. mutant) form). In some embodiments, the mutations which attenuate or reduce binding or affinity include those mutations which substantially reduce or ablate binding or activity. In some embodiments, the mutations which attenuate or reduce binding or affinity are different than those mutations which substantially reduce or ablate binding or activity. Consequentially, in some embodiments, the mutations allow for the signaling agent to have improved safety, e.g. reduced systemic toxicity, reduced side effects, and reduced off-target effects relative to unmutated, i.e., wild type, signaling agent (e.g. comparing the same signaling agent in a wild type form versus a modified (e.g. mutant) form).

As described herein, the agent may have improved safety due to one of more modifications, e.g. mutations. In some embodiments, improved safety means that the present chimeric protein or Fc-based chimeric protein complex provides lower toxicity (e.g. systemic toxicity and/or tissue/organ-associated toxicities); and/or lessened or substantially eliminated side effects; and/or increased tolerability, lessened or substantially eliminated adverse events; and/or reduced or substantially eliminated off-target effects; and/or an increased therapeutic window.

In some embodiments, the signaling agent is modified to have one or more mutations that reduce its binding affinity or activity for one or more of its receptors. In some embodiments, the signaling agent is modified to have one or more mutations that substantially reduce or ablate binding affinity or activity for the receptors. In some embodiments, the activity provided by the wild type signaling agent is agonism at the receptor (e.g. activation of a cellular effect at a site of therapy). For example, the wild type signaling agent may activate its receptor. In such embodiments, the mutations result in the modified signaling agent to have reduced or ablated activating activity at the receptor. For example, the mutations may result in the modified signaling agent to deliver a reduced activating signal to a target cell or the activating signal could be ablated. In some embodiments, the activity provided by the wild type signaling agent is antagonism at the receptor (e.g. blocking or dampening of a cellular effect at a site of therapy). For example, the wild type signaling agent may antagonize or inhibit the receptor. In these embodiments, the mutations result in the modified signaling agent to have a reduced or ablated antagonizing activity at the receptor. For example, the mutations may result in the modified signaling agent to deliver a reduced inhibitory signal to a target cell or the inhibitory signal could be ablated. In some embodiments, the signaling agent is antagonistic due to one or more mutations, e.g. an agonistic signaling agent is converted to an antagonistic signaling agent (e.g. as described in WO 2015/007520, the entire contents of which are hereby incorporated by reference) and, such a converted signaling agent, optionally, also bears one or mutations that reduce its binding affinity or activity for one or more of its receptors or that substantially reduce or ablate binding affinity or activity for one or more of its receptors.

In some embodiments, the reduced affinity or activity at the receptor is restorable by attachment with one or more of the targeting moieties as described herein (e.g., targeting moiety against FAP) or upon inclusion in the Fc-based chimeric protein complex as disclosed herein. In other embodiments, the reduced affinity or activity at the receptor is not substantially restorable by the activity of one or more of the targeting moieties or upon inclusion in the Fc-based chimeric protein complex as disclosed herein.

In some embodiments, the chimeric proteins or Fc-based chimeric protein complex of the present technology reduce off-target effects because their signaling agents have mutations that weaken or ablate binding affinity or activity at a receptor. In some embodiments, this reduction in side effects is observed relative with, for example, the wild type signaling agents. In some embodiments, the signaling agent is active on target cells because the targeting moiety(ies) compensates for the missing/insufficient binding (e.g., without limitation and/or avidity) required for substantial activation. In some embodiments, the modified signaling agent is substantially inactive enroute to the site of therapeutic activity and has its effect substantially on specifically targeted cell types which greatly reduces undesired side effects.

In some embodiments, the signaling agent may include one or more mutations that attenuate or reduce binding or affinity for one receptor (i.e., a therapeutic receptor) and one or more mutations that substantially reduce or ablate binding or activity at a second receptor. In such embodiments, these mutations may be at the same or at different positions (i.e., the same mutation or multiple mutations). In some embodiments, the mutation(s) that reduce binding and/or activity at one receptor is different than the mutation(s) that substantially reduce or ablate at another receptor. In some embodiments, the mutation(s) that reduce binding and/or activity at one receptor is the same as the mutation(s) that substantially reduce or ablate at another receptor. In some embodiments, the present chimeric proteins or Fc-based chimeric protein complex have a modified signaling agent that has both mutations that attenuate binding and/or activity at a therapeutic receptor and therefore allow for a more controlled, on-target therapeutic effect (e.g. relative wild type signaling agent) and mutations that substantially reduce or ablate binding and/or activity at another receptor and therefore reduce side effects (e.g. relative to wild type signaling agent).

In some embodiments, the substantial reduction or ablation of binding or activity is not substantially restorable with a targeting moiety (e.g., a targeting moiety against FAP or any other targeting moiety described herein) or upon inclusion in the Fc-based chimeric protein complex as disclosed herein. In some embodiments, the substantial reduction or ablation of binding or activity is restorable with a targeting moiety or upon inclusion in the Fc-based chimeric protein complex as disclosed herein. In some embodiments, substantially reducing or ablating binding or activity at a second receptor also may prevent deleterious effects that are mediated by the other receptor. Alternatively, or in addition, substantially reducing or ablating binding or activity at the other receptor causes the therapeutic effect to improve as there is a reduced or eliminated sequestration of the therapeutic chimeric proteins away from the site of therapeutic action. For instance, in some embodiments, this obviates the need of high doses of the present chimeric proteins or Fc-based chimeric protein complex that compensate for loss at the other receptor. Such ability to reduce dose further provides a lower likelihood of side effects.

In some embodiments, the modified signaling agent comprises one or more mutations that cause the signaling agent to have reduced, substantially reduced, or ablated affinity, e.g. binding (e.g. KD) and/or activation (for instance, when the modified signaling agent is an agonist of its receptor, measurable as, for example, KA and/or EC50) and/or inhibition (for instance, when the modified signaling agent is an antagonist of its receptor, measurable as, for example, Ki and/or 1050), for one or more of its receptors. In some embodiments, the reduced affinity at the immunomodulating agent's receptor allows for attenuation of activity (inclusive of agonism or antagonism). In such embodiments, the modified signaling agent has about 1%, or about 3%, about 5%, about 10%, about 15%, about 20%, about 25%, about 30%, about 35%, about 40%, about 45%, about 50%, about 60%, about 65%, about 70%, about 75%, about 80%, about 85%, about 90%, about 95%, or about 10%-20%, about 20%-40%, about 50%, about 40%-60%, about 60%-80%, about 80%-100% of the affinity for the receptor relative to the wild type signaling agent. In some embodiments, the binding affinity is at least about 2-fold lower, about 3-fold lower, about 4-fold lower, about 5-fold lower, about 6-fold lower, about 7-fold lower, about 8-fold lower, about 9-fold lower, at least about 10-fold lower, at least about 15-fold lower, at least about 20-fold lower, at least about 25-fold lower, at least about 30-fold lower, at least about 35-fold lower, at least about 40-fold lower, at least about 45-fold lower, at least about 50-fold lower, at least about 100-fold lower, at least about 150-fold lower, or about 10-50-fold lower, about 50-100-fold lower, about 100-150-fold lower, about 150-200-fold lower, or more than 200-fold lower relative to the wild type signaling agent.

In embodiments wherein the modified signaling agent has mutations that reduce binding at one receptor and substantially reduce or ablate binding at a second receptor, the attenuation or reduction in binding affinity of a modified signaling agent for one receptor is less than the substantial reduction or ablation in affinity for the other receptor. In some embodiments, the attenuation or reduction in binding affinity of a modified signaling agent for one receptor is less than the substantial reduction or ablation in affinity for the other receptor by about 1%, or about 3%, about 5%, about 10%, about 15%, about 20%, about 25%, about 30%, about 35%, about 40%, about 45%, about 50%, about 60%, about 65%, about 70%, about 75%, about 80%, about 85%, about 90%, or about 95%. In some embodiments, substantial reduction or ablation refers to a greater reduction in binding affinity and/or activity than attenuation or reduction.

In some embodiments, the modified signaling agent comprises one or more mutations that reduce the endogenous activity of the signaling agent to about 75%, or about 70%, or about 60%, or about 50%, or about 40%, or about 30%, or about 25%, or about 20%, or about 10%, or about 5%, or about 3%, or about 1%, e.g., relative to the wild type signaling agent.

In some embodiments, the modified signaling agent comprises one or more mutations that cause the signaling agent to have reduced affinity for its receptor that is lower than the binding affinity of the targeting moiety(ies) for its(their) receptor(s). In some embodiments, this binding affinity differential is between signaling agent/receptor and targeting moiety/receptor on the same cell. In some embodiments, this binding affinity differential allows for the signaling agent, e.g. mutated signaling agent, to have localized, on-target effects and to minimize off-target effects that underlie side effects that are observed with wild type signaling agent. In some embodiments, this binding affinity is at least about 2-fold, or at least about 5-fold, or at least about 10-fold, or at least about 15-fold lower, or at least about 25-fold, or at least about 50-fold lower, or at least about 100-fold, or at least about 150-fold.

Receptor binding activity may be measured using methods known in the art. For example, affinity and/or binding activity may be assessed by Scatchard plot analysis and computer-fitting of binding data (e.g. Scatchard, 1949) or by reflectometric interference spectroscopy under flow through conditions, as described by Brecht et al. (1993), the entire contents of all of which are hereby incorporated by reference.

In various embodiments, the additional signaling agent is selected from wildtype or modified versions of cytokines, growth factors, monokines, traditional polypeptide hormones, such as human growth hormone, N-methionyl human growth hormone, and bovine growth hormone; parathyroid hormone; thyroxine; insulin; proinsulin; relaxin; prorelaxin; glycoprotein hormones such as follicle stimulating hormone (FSH), thyroid stimulating hormone (TSH), and luteinizing hormone (LH); hepatic growth factor; fibroblast growth factor; prolactin; placental lactogen; tumor necrosis factor-α and tumor necrosis factor-β; mullerian-inhibiting substance; mouse gonadotropin-associated peptide; inhibin; activin; vascular endothelial growth factor; integrin; thrombopoietin (TPO); nerve growth factors such as NGF-α; platelet-growth factor; transforming growth factors (TGFs) such as TGF-α and TGF-β; insulin-like growth factor-I and -II; osteo inductive factors; interferons such as, for example, interferon-α, interferon-β and interferon-γ (and interferon type I, II, and III), colony stimulating factors (CSFs) such as macrophage-CSF (M-CSF); granulocyte-macrophage-CSF (GM-CSF); and granulocyte-CSF (G-CSF); interleukins (ILs) such as, for example, IL-113, IL-1a, IL-2, IL-3, IL-4, IL-5, IL-6, IL-7, IL-8, IL-9, IL-10, IL-11, IL-12, IL-13, and IL-18; a tumor necrosis factor such as, for example, TNF-α or TNF-β; and other polypeptide factors including, for example, LIF and kit ligand (KL). As used herein, cytokines, growth factors, and hormones include proteins obtained from natural sources or produced from recombinant bacterial, eukaryotic or mammalian cell culture systems and biologically active equivalents of the native sequence cytokines.

In some embodiments, the additional signaling agent is a wildtype or modified version of a growth factor selected from, but not limited to, transforming growth factors (TGFs) such as TGF-α and TGF-β, epidermal growth factor (EGF), insulin-like growth factor such as insulin-like growth factor-I and -II, fibroblast growth factor (FGF), heregulin, platelet-derived growth factor (PDGF), vascular endothelial growth factor (VEGF).

In an embodiment, the growth factor is a wildtype or modified version of a fibroblast growth factor (FGF). Illustrative FGFs include, but are not limited to, FGF1, FGF2, FGF3, FGF4, FGF5, FGF6, FGF7, FGF8, FGF9, FGF10, FGF11, FGF12, FGF13, FGF14, murine FGF15, FGF16, FGF17, FGF18, FGF19, FGF20, FGF21, FGF22, and FGF23.

In an embodiment, the growth factor is a wildtype or modified version of a transforming growth factor (TGF). Illustrative TGFs include, but are not limited to, TGF-α and TGF-β and subtypes thereof including the various subtypes of TGF-β including TGFβ1, TGFβ2, and TGFβ3.

In some embodiments, the additional signaling agent is a wildtype or modified version of a hormone selected from, but not limited to, human chorionic gonadotropin, gonadotropin releasing hormone, an androgen, an estrogen, thyroid-stimulating hormone, follicle-stimulating hormone, luteinizing hormone, prolactin, growth hormone, adrenocorticotropic hormone, antidiuretic hormone, oxytocin, thyrotropin-releasing hormone, growth hormone releasing hormone, corticotropin-releasing hormone, somatostatin, dopamine, melatonin, thyroxine, calcitonin, parathyroid hormone, glucocorticoids, mineralocorticoids, adrenaline, noradrenaline, progesterone, insulin, glucagon, amylin, calcitriol, calciferol, atrial-natriuretic peptide, gastrin, secretin, cholecystokinin, neuropeptide Y, ghrelin, PYY3-36, insulin-like growth factor (IGF), leptin, thrombopoietin, erythropoietin (EPO), and angiotensinogen.

In some embodiments, the signaling agent is an immune-modulating agent, e.g. one or more of an interleukin, interferon, and tumor necrosis factor.

In some embodiments, the signaling agent is a wildtype interleukin or a modified interleukin, including for example IL-1; IL-113, IL-2; IL-3; IL-4; IL-5; IL-6; IL-7; IL-8; IL-9; IL-10; IL-11; IL-12; IL-13; IL-14; IL-15; IL-16; IL-17; IL-18; IL-19; IL-20; IL-21; IL-22; IL-23; IL-24; IL-25; IL-26; IL-27; IL-28; IL-29; IL-30; IL-31; IL-32; IL-33; IL-35; IL-36 or a fragment, variant, analogue, or family-member thereof. Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in Lymphokines and Interferons: A Practical Approach, Clemens et al., eds, IRL Press, Washington, D.C. 1987, pp. 221-225; and Orencole & Dinarello (1989) Cytokine 1, 14-20.

In some embodiments, the signaling agent is a wildtype interferon or a modified version of an interferon such as interferon types I, II, and III. Illustrative interferons, including for example, interferon-a-1, 2, 4, 5, 6, 7, 8, 10, 13, 14, 16, 17, and 21, interferon-β and interferon-γ, interferon κ, interferon ε, interferon τ, interferon δ, IFN-v, and interferon ω̄.

In some embodiments, the signaling agent is a wildtype tumor necrosis factor (TNF) or a modified version of a tumor necrosis factor (TNF) or a protein in the TNF family, including but not limited to, TNF-α, TNF-β, LT-β, CD40L, CD27L, CD30L, FASL, 4-1BBL, OX40L, and TRAIL.

The amino acid sequences of the wild type signaling agents described herein are well known in the art. Accordingly, in some embodiments the modified signaling agent comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74% or at least about 75% or at least about 76%, or at least about 77%, or at least about 78%, or at least about 79%, or at least about 80%, or at least about 81%, or at least about 82%, or at least about 83% at least about 84%, or at least at least about 85%, or at least about 86%, or at least about 87%, or at least about 88%, or at least about 89%, or at least about 90%, or at least about 91% or at least about 92%, or at least about 93%, or at least about 94%, or at least about 95%, or at least about 96%, or at least about 97%, or at least about 98%, or at least about 99% sequence identity with the known wild type amino acid sequences of the signaling agents described herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In some embodiments the modified signaling agent comprises an amino acid sequence that has at least about 60%, or at least about 61%, 65%, or at least about 66%, 70%, or at least about 71%, 75%, or at least about 76%, 80%, or at least about 81%, 85%, or at least about 86%, 90%, or at least about 91%, or at least about 62%, or at least about 67%, or at least about 72%, or at least about 77%, or at least about 82%, or at least about 87%, or at least about 92% or at least about 63%, or at least about 68%, or at least about 73%, or at least about 78%, or at least about 83%, or at least about 88%, or at least about 93% or at least about 64%, or at least about 69%, or at least about 74%, or at least about 79%, or at least about 84%, or at least about 89%, or at least about 94% or at least about or at least about or at least about or at least about or at least about or at least about or at least about or at least about 95%, or at least about 96%, or at least about 97%, or at least about 98%, or at least about 99% sequence identity with any amino acid sequences of the signaling agents described herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In some embodiments, the modified signaling agent comprises an amino acid sequence having one or more amino acid mutations. In some embodiments, the one or more amino acid mutations may be independently selected from substitutions, insertions, deletions, and truncations. In some embodiments, the amino acid mutations are amino acid substitutions, and may include conservative and/or non-conservative substitutions, as described elsewhere herein. In some embodiments, the substitutions may also include non-classical amino acids as described elsewhere herein.

As described herein, the modified signaling agents bear mutations that affect affinity and/or activity at one or more receptors. In some embodiments, there is reduced affinity and/or activity at a therapeutic receptor, e.g. a receptor through which a desired therapeutic effect is mediated (e.g. agonism or antagonism). In some embodiments, the modified signaling agents bear mutations that substantially reduce or ablate affinity and/or activity at a receptor, e.g. a receptor through which a desired therapeutic effect is not mediated (e.g. as the result of promiscuity of binding). The receptors of any modified signaling agents, e.g. one of the cytokines, growth factors, and hormones as described herein, are known in the art.

Illustrative mutations which provide reduced affinity and/or activity (e.g. agonistic) at a receptor are found in WO 2013/107791 and PCT/EP2017/061544 (e.g. with regard to interferons), WO 2015/007542 (e.g. with regard to interleukins), and WO 2015/007903 (e.g. with regard to TN F), the entire contents of each of which are hereby incorporated by reference. Illustrative mutations which provide reduced affinity and/or activity (e.g. antagonistic) at a therapeutic receptor are found in WO 2015/007520, the entire contents of which are hereby incorporated by reference.

In some embodiments, the modified signaling agent comprises one or more mutations that cause the signaling agent to have reduced affinity and/or activity for a type I cytokine receptor, a type II cytokine receptor, a chemokine receptor, a receptor in the Tumor Necrosis Factor Receptor (TNFR) superfamily, TGF-beta Receptors, a receptor in the immunoglobulin (Ig) superfamily, and/or a receptor in the tyrosine kinase superfamily.

In some embodiments, the receptor for the signaling agent is a Type I cytokine receptor. Type I cytokine receptors are known in the art and include, but are not limited to receptors for IL2 (beta-subunit), IL3, IL4, IL5, IL6, IL7, IL9, ID 1, IL12, GM-CSF, G-CSF, LIF, CNTF, and also the receptors for Thrombopoietin (TPO), Prolactin, and Growth hormone. Illustrative type I cytokine receptors include, but are not limited to, GM-CSF receptor, G-CSF receptor, LIF receptor, CNTF receptor, TPO receptor, and type I IL receptors.

In some embodiments, the receptor for the signaling agent is a Type II cytokine receptor. Type II cytokine receptors are multimeric receptors composed of heterologous subunits, and are receptors mainly for interferons. This family of receptors includes, but is not limited to, receptors for interferon-a, interferon-13 and interferon-y, IL10, IL22, and tissue factor. Illustrative type II cytokine receptors include, but are not limited to, IFN-αreceptor (e.g. IFNAR1 and IFNAR2), IFN-3 receptor, IFN-γ receptor (e.g. IFNGR1 and IFNGR2), and type II IL receptors.

In some embodiments, the receptor for the signaling agent is a G protein-coupled receptor. Chemokine receptors are G protein-coupled receptors with seven transmembrane structure and coupled to G-protein for signal transduction. Chemokine receptors include, but are not limited to, CC chemokine receptors, CXC chemokine receptors, CX3C chemokine receptors, and XC chemokine receptor (XCR1). Illustrative chemokine receptors include, but are not limited to, CCR1, CCR2, CCR3, CCR4, CCRS, CCR6, CCR7, CCR8, CCR9, CCR10, CXCR1, CXCR2, CXCR3, CXCR3B, CXCR4, CXCRS, CSCR6, CXCR7, XCR1, and CX3CR1.

In some embodiments, the receptor for the signaling agent is a TNFR family member. Tumor necrosis factor receptor (TNFR) family members share a cysteine-rich domain (CRD) formed of three disulfide bonds surrounding a core motif of CXXCXXC creating an elongated molecule. Illustrative tumor necrosis factor receptor family members include: CDI 20a (TNFRSFIA), CD 120b (TNFRSFIB), Lymphotoxin beta receptor (LTBR, TNFRSF3), CD 134 (TNFRSF4), CD40 (CD40, TNFRSFS), FAS (FAS, TNFRSF6), TNFRSF6B (TNFRSF6B), CD27 (CD27, TNFRSF7), CD30 (TNFRSF8), CD137 (TNFRSF9), TNFRSFIOA (TNFRSFIOA), TNFRSFIOB, (TNFRS-FIOB), TNFRSFIOC (TNFRSFIOC), TNFRSFIOD (TN-FRSFIOD), RANK (TNFRSFI IA), Osteoprotegerin (TN-FRSFI IB), TNFRSF12A (TNFRSF12A), TNFRSF13B (TNFRSF13B), TNFRSF13C (TNFRSF13C), TNFRSF14 (TNFRSF14), Nerve growth factor receptor (NGFR, TNFRSF16), TNFRSF17 (TNFRSF17), TNFRSF18 (TN-FRSF18), TNFRSF19 (TNFRSF19), TNFRSF21 (TN-FRSF21), and TNFRSF25 (TNFRSF25). In an embodiment, the TNFR family member is CD120a (TNFRSF1A) or TNF-R1. In another embodiment, the TNFR family member is CD 120b (TNFRSFIB) or TNF-R2.

In some embodiments, the receptor for the signaling agent is a TGF-beta receptor. TGF-beta receptors are single pass serine/threonine kinase receptors. TGF-beta receptors include, but are not limited to, TGFBR1, TGFBR2, and TGFBR3.

In some embodiments, the receptor for the signaling agent is an Ig superfamily receptor. Receptors in the immunoglobulin (Ig) superfamily share structural homology with immunoglobulins. Receptors in the Ig superfamily include, but are not limited to, interleukin-1 receptors, CSF-1R, PDGFR (e.g. PDGFRA and PDGFRB), and SCFR.

In some embodiments, the receptor for the signaling agent is a tyrosine kinase superfamily receptor. Receptors in the tyrosine kinase superfamily are well known in the art. There are about 58 known receptor tyrosine kinases (RTKs), grouped into 20 subfamilies. Receptors in the tyrosine kinase superfamily include, but are not limited to, FGF receptors and their various isoforms such as FGFR1, FGFR2, FGFR3, FGFR4, and FGFR5.

In some embodiments, the wildtype or modified signaling agent is interferon α. In some embodiments, the modified IFN-α agent has reduced affinity and/or activity for the IFN-α/β receptor (IFNAR), i.e., IFNAR1 and/or IFNAR2 chains. In some embodiments, the modified IFN-α agent has substantially reduced or ablated affinity and/or activity for the IFN-α/β receptor (IFNAR), i.e., IFNAR1 and/or IFNAR2 chains. In some embodiments, the modified IFN-α agent is a human modified IFN-α agent.

Mutant forms of interferon are known to the person skilled in the art. By way of example, but not by way of limitation, in some embodiments, the modified signaling agent is the allelic form IFN-α2a having the amino acid sequence of: SEQ ID NO: 176.

By way of example, but not by way of limitation, in some embodiments, the modified signaling agent is the allelic form IFN-α2b having the amino acid sequence of: SEQ ID NO: 177; which differs from IFN-α2a at amino acid position 23.

In some embodiments, a modified IFN-α2 signaling agent is a human IFN-α2 mutant (IFN-α2a or IFN-α2b). In some embodiments, the human IFN-α2 mutant (IFN-α2a or IFN-α2b) is mutated at one or more amino acids at positions 144-154, e.g., such as amino acid positions 148, 149 and/or 153. In some embodiments, the human IFN-α2 mutant comprises one or more mutations selected from L153A, R149A, and M148A.

In some embodiments, the IFN-α2 mutants have reduced affinity and/or activity for IFNAR1. In some embodiments, the IFN-α2 mutant is a human IFN-α2 mutant comprising one or more mutations selected from F64A, N65A, T69A, L80A, Y85A, and Y89A, as described in WO2010/030671, the entire contents of which is hereby incorporated by reference.

In some embodiments, the IFN-α2 mutant is a human IFN-α2 mutant comprising one or more mutations selected from K133A, R144A, R149A, and L153A, as described in WO2008/124086, the entire contents of which is hereby incorporated by reference.

In some embodiments, the IFN-α2 mutant is a human IFN-α2 mutant comprising one or more mutations selected from R120E and R120E/K121E, as described in WO2015/007520 and WO2010/030671, the entire contents of which are hereby incorporated by reference.

In some embodiments, the IFN-α2 mutant antagonizes wild type IFN-α2 activity. In some embodiments, said mutant IFN-α2 has reduced affinity and/or activity for IFNAR1, while affinity and/or activity of IFNR2 is retained.

In some embodiments, a human IFN-α2 mutant comprises (1) one or more mutations selected from R120E and R120E/K121E, which, without wishing to be bound by theory, create an antagonistic effect and (2) one or more mutations selected from K133A, R144A, R149A, and L153A, which, without wishing to be bound by theory, allow for an attenuated effect at, for example, IFNAR2. In some embodiments, the human IFN-α2 mutant comprises R120E and L153A.

In some embodiments, the human IFN-α2 mutant comprises one or more mutations selected from L15A, A19W, R22A, R23A, L26A, F27A, L30A, L30V, K31A, D32A, R33K, R33A, R33Q, H34A, D35A, Q40A, D114R, L117A, R120A, R125A, K134A, R144A, A145G, A145M, M148A, R149A, S152A, L153A, and N156A as disclosed in WO 2013/059885, the entire disclosures of which are hereby incorporated by reference. In some embodiments, the human IFN-α2 mutant comprises the mutations H57Y, E58N, Q61S, and/or L30A as disclosed in WO 2013/059885. In some embodiments, the human IFN-α2 mutant comprises the mutations H57Y, E58N, Q61S, and/or R33A as disclosed in WO 2013/059885. In some embodiments, the human IFN-α2 mutant comprises the mutations H57Y, E58N, Q61S, and/or M148A as disclosed in WO 2013/059885. In some embodiments, the human IFN-α2 mutant comprises the mutations H57Y, E58N, Q61S, and/or L153A as disclosed in WO 2013/059885. In some embodiments, the human IFN-α2 mutant comprises the mutations N65A, L80A, Y85A, and/or Y89A as disclosed in WO 2013/059885. In some embodiments, the human IFN-α2 mutant comprises the mutations N65A, L80A, Y85A, Y89A, and/or D114A as disclosed in WO 2013/059885. In some embodiments, the human IFN-α2 mutant comprises the mutations R144$X_1$, A145$X_2$, and R33A, wherein $X_1$ is selected from A, S, T, Y, L, and I, and wherein $X_2$ is selected from G, H, Y, K, and D. In some embodiments, the mutant human IFNα2 has one or more mutations selected from R33A, T106$X_3$, R120E, R144$X_1$ A145$X_2$, M148A, R149A, and L153A with respect to amino acid sequence of SEQ ID NO: 176 or 177, wherein $X_1$ is selected from A, S, T, Y, L, and I, wherein $X_2$ is selected from G, H, Y, K, and D, and wherein $X_3$ is selected from A and E.

In some embodiments, the signaling agent is a wild type interferon α1 or a modified interferon α1. In some embodiments, the present invention provides a chimeric protein or Fc-based chimeric protein complex that includes a wild type IFNα1. In various embodiments, the wild-type IFNα1 comprises the following amino acid sequence:

```
                                    (SEQ ID NO: 1042)
CDLPETHSLDNRRTLMLLAQMSRISPSSCLMDRHDFGFPQEEFDGNQFQKA

PAISVLHELIQQIFNLFTTKDSSAAWDEDLLDKFCTELYQQLNDLEACVMQ

EERVGETPLMNADSILAVKKYFRRITLYLTEKKYSPCAWEVVRAEIMRSLS

LSTNLQERLRRKE.
```

In various embodiments, the chimeric protein or Fc-based chimeric protein complex of the invention comprises a modified version of IFNα1, i.e., a IFNα1 variant including a IFNα1 mutant, as a signaling agent. In various embodiments, the IFNα1 variant encompasses mutants, functional derivatives, analogs, precursors, isoforms, splice variants, or fragments of the interferon. In some embodiments, the IFNα1 interferon is modified to have a mutation at one or more amino acids at positions L15, A19, R23, S25, L30, D32, R33, H34, Q40, C86, D115, L118, K121, R126, E133, K134, K135, R145, A146, M149, R150, S153, L154, and N157 with reference to SEQ ID NO: 1042. The mutations can optionally be a hydrophobic mutation and can be, e.g., selected from alanine, valine, leucine, and isoleucine. In some embodiments, the IFNα1 interferon is modified to have a one or more mutations selected from L15A, A19W, R23A, S25A, L30A, L30V, D32A, R33K, R33A, R33Q, H34A, Q40A, C86S, C86A, D115R, L118A, K121A, K121E, R126A, R126E, E133A, K134A, K135A, R145A, R145D, R145E, R145G, R145H, R145I, R145K, R145L, R145N, R145Q, R145S, R145T, R145V, R145Y, A146D, A146E, A146G, A146H, A146I, A146K, A146L, A146M, A146N, A146Q, A146R, A146S, A146T, A146V, A146Y, M149A, M149V, R150A, S153A, L154A, and N157A with reference to SEQ ID NO: 1042. In some embodiments, the IFNα1 mutant comprises one or more multiple mutations selected from L30A/H58Y/E59N_Q62S, R33A/H58Y/E59N/Q62S, M149A/H58Y/E59N/Q62S, L154A/H58Y/E59N/Q62S, R145A/H58Y/E59N/Q62S, D115A/R121A, L118A/R121A, L118A/R121A/K122A, R121A/K122A, and R121E/K122E with reference to SEQ ID NO: 1042).

In some embodiments, the IFN-α1 is a variant that comprises one or more mutations which reduce undesired disulphide pairings wherein the one or more mutations are, e.g., at amino acid positions C1, C29, C86, C99, or C139 with reference to SEQ ID NO: 1042. In some embodiments, the mutation at position C86 can be, e.g., C86S or C86A or C86Y. These C86 mutants of IFN-α1 are called reduced cysteine-based aggregation mutants. In some embodiment, the IFNα1 variant includes mutations at positions C1, C86 and C99 with reference to SEQ ID NO: 1042.

In an embodiment, the wildtype or modified signaling agent is interferon β. In such embodiments, the modified interferon β agent has reduced affinity and/or activity for the IFN-α/β receptor (IFNAR), i.e., IFNAR1 and/or IFNAR2 chains. In some embodiments, the modified interferon β agent has substantially reduced or ablated affinity and/or activity for the IFN-α/β receptor (IFNAR), i.e., IFNAR1 and/or IFNAR2 chains.

In an illustrative embodiment, the modified signaling agent is IFN-β. In some embodiments, the IFN-β encompasses functional derivatives, analogs, precursors, isoforms, splice variants, or fragments of IFN-β. In some embodiments, the IFN-β encompasses IFN-β derived from any species. In an embodiment, the chimeric protein or Fc-based chimeric protein complex comprises a modified version of mouse IFN-β. In another embodiment, the chimeric protein or Fc-based chimeric protein complex comprises a modified version of human IFN-β. Human IFN-β is a polypeptide with a molecular weight of about 22 kDa comprising 166 amino acid residues. The amino acid sequence of human IFN-β is shown as SEQ ID NO: 178.

In some embodiments, the human IFN-β is IFN-β-Ia, which is a glycosylated form of human IFN-β. In some embodiments, the human IFN-β is IFN-β-Ib, which is a non-glycosylated form of human IFN-β that has a Met-1 deletion and a Cys-17 to Ser mutation.

In some embodiments, the modified IFN-β has one or more mutations that reduce its binding to or its affinity for the IFNAR1 subunit of IFNAR. In some embodiments, the modified IFN-β has reduced affinity and/or activity at IFNAR1.

In some embodiments, the modified IFN-β with reduced affinity and/or activity at IFNAR1 is human IFN-β and has one or more mutations at positions F67, R71, L88, Y92, 195, N96, K123, and R124. In some embodiments, the one or more mutations are substitutions selected from F67G, F67S, R71A, L88G, L88S, Y92G, Y92S, 195A, N96G, K123G, and R124G. In some embodiments, the modified human IFN-β comprises the F67G mutation. In some embodiments, the modified human IFN-β comprises the K123G mutation. In some embodiments, the modified human IFN-β comprises the F67G and R71A mutations. In some embodiments, the modified human IFN-β comprises the L88G and Y92G mutations. In some embodiments, the modified human IFN-β comprises the Y92G, 195A, and N96G mutations. In some embodiments, the modified human IFN-β comprises the K123G and R124G mutations. In some embodiments, the modified human IFN-β comprises the F67G, L88G, and Y92G mutations. In some embodiments, the modified human IFN-β comprises the F67S, L88S, and Y92S mutations.

In some embodiments, the modified IFN-β has one or more mutations that reduce its binding to or its affinity for the IFNAR2 subunit of IFNAR. In some embodiments, the modified IFN-β has reduced affinity and/or activity at IFNAR2.

In some embodiments, the modified IFN-β reduced affinity and/or activity at IFNAR2 is human IFN-β and has one or more mutations at positions W22, R27, L32, R35, V148, L151, R152, and Y155. In some embodiments, the one or more mutations are substitutions selected from W22G, R27G, L32A, L32G, R35A, R35G, V148G, L151G, R152A, R152G, and Y155G. In some embodiments, the modified human IFN-β comprises the W22G mutation. In some embodiments, the modified human IFN-β comprises the L32A mutation. In some embodiments, the modified human IFN-β comprises the L32G mutation. In some embodiments, the modified human IFN-β comprises the R35A mutation. In some embodiments, the modified human IFN-β comprises the R35G mutation. In some embodiments, the modified human IFN-β comprises the V148G mutation. In some embodiments, the modified human IFN-β comprises the R152A mutation. In some embodiments, the modified human IFN-β comprises the R152G mutation. In some embodiments, the modified human IFN-β comprises the Y155G mutation. In some embodiments, the modified human IFN-β comprises the W22G and R27G mutations. In some embodiments, the modified human IFN-β comprises the L32A and R35A mutation. In some embodiments, the modified human IFN-β comprises the L151G and R152A mutations. In some embodiments, the modified human IFN-β comprises the V148G and R152A mutations.

In some embodiments, the modified IFN-β has one or more of the following mutations: R35A, R35T, E42K, M621, G78S, A141Y, A142T, E149K, and R152H. In some embodiments, the modified IFN-β has one or more of the following mutations: R35A, R35T, E42K, M621, G78S, A141Y, A142T, E149K, and R152H in combination with C175 or MA.

In some embodiments, the modified IFN-β has one or more of the following mutations: R35A, R35T, E42K, M621, G78S, A141Y A142T, E149K, and R152H in combination with any of the other IFN-β mutations described herein.

The crystal structure of human IFN-β is known and is described in Karpusas et al., (1998) PNAS, 94(22): 11813-11818. Specifically, the structure of human IFN-β has been shown to include five a-helices (i.e., A, B, C, D, and E) and four loop regions that connect these helices (i.e., AB, BC, CD, and DE loops). In some embodiments, the modified IFN-β has one or more mutations in the A, B, C, D, E helices and/or the AB, BC, CD, and DE loops, which reduce its binding affinity or activity at a therapeutic receptor such as IFNAR. Illustrative mutations are described in WO 2000/023114 and US 20150011732, the entire contents of which are hereby incorporated by reference.

In an illustrative embodiment, the modified IFN-β is human IFN-β comprising alanine substitutions at amino acid positions 15, 16, 18, 19, 22, and/or 23. In an illustrative embodiment, the modified IFN-β is human IFN-β comprising alanine substitutions at amino acid positions 28-30, 32, and 33. In an illustrative embodiment, the modified IFN-β is human IFN-β comprising alanine substitutions at amino acid positions 36, 37, 39, and 42. In an illustrative embodiment, the modified IFN-β is human IFN-β comprising alanine substitutions at amino acid positions 64 and 67 and a serine substitution at position 68. In an illustrative embodiment, the modified IFN-β is human IFN-β comprising alanine substitutions at amino acid positions 71-73. In an illustrative embodiment, the modified IFN-β is human IFN-β comprising alanine substitutions at amino acid positions 92, 96, 99, and 100. In an illustrative embodiment, the modified I FN-β is human IFN-β comprising alanine substitutions at amino acid positions 128, 130, 131, and 134. In an illustrative embodiment, the modified IFN-β is human IFN-β comprising alanine substitutions at amino acid positions 149, 153, 156, and 159. In some embodiments, the mutant IFN-β comprises SEQ ID NO: 178 and a mutation at W22, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at R27, wherein the mutations is an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at W22, wherein the mutations is an aliphatic hydrophobic residue selected from glycine (G), alanine (A), leucine (L), isoleucine (I), methionine (M), and valine (V) and a mutation at R27, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at L32, the mutation being an aliphatic hydrophobic residue selected from glycine (G), alanine (A), isoleucine (I), methionine (M), and valine (V).

In some embodiments, the mutant IFN-β comprises SEQ ID NO: 178 and a mutation at R35, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at L32, the mutation being an aliphatic hydrophobic residue selected from glycine (G), alanine (A), isoleucine (I), methionine (M), and valine (V) and a mutation at R35, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at F67, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at R71, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at F67, the mutation being an aliphatic hydrophobic residue selected from glycine (G), alanine (A), leucine (L), isoleucine (I), methionine (M), and valine (V) and a mutation at R71, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at L88, the mutation being an aliphatic hydrophobic residue selected from glycine (G), alanine (A), isoleucine (I), methionine (M), and valine (V).

In some embodiments, the mutant IFN-β comprises SEQ ID NO: 178 and a mutation at Y92, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at F67, the mutation being an aliphatic hydrophobic residue selected from glycine (G), alanine (A), leucine (L), isoleucine (I), methionine (M), and valine (V) and a mutation at L88, the mutation being an aliphatic hydrophobic residue selected from glycine (G), alanine (A), isoleucine (I), methionine (M), and valine (V) and a mutation at Y92, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at L88, the mutation being an aliphatic hydrophobic residue selected from glycine (G), alanine (A), isoleucine (I), methionine (M), and valine (V) and a mutation at Y92, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at 195, the mutation being an aliphatic hydrophobic residue selected from glycine (G), alanine (A), leucine (L), methionine (M), and valine (V) and a mutation at Y92, the mutation being an aliphatic hydrophobic residue selected from glycine (G), alanine (A), leucine (L), isoleucine (1), methionine (M), and valine (V).

In some embodiments, the mutant IFN-β comprises SEQ ID NO: 178 and a mutation at N96, the mutation being an aliphatic hydrophobic residue selected from glycine (G), alanine (A), leucine (L), isoleucine (I), methionine (M), and valine (V) and a mutation at Y92, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at Y92, the mutation being an aliphatic hydrophobic residue selected from glycine (G), alanine (A), leucine (L), isoleucine (I), methionine (M), and valine (V) and a mutation at 195, the mutation being an aliphatic hydrophobic residue selected from glycine (G), alanine (A), leucine (L), methionine (M), and valine (V) and a mutation at N96, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at K123, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at R124, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at K123, the mutation being an aliphatic hydrophobic residue selected from glycine (G), alanine (A), leucine (L), isoleucine (I), methionine (M), and valine (V) and a mutation at R124, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at L151, the mutation being an aliphatic hydrophobic residue selected from glycine (G), alanine (A), isoleucine (I), methionine (M), and valine (V).

In some embodiments, the mutant IFN-β comprises SEQ ID NO: 178 and a mutation at R152, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at L151, the mutation being an aliphatic hydrophobic residue selected from glycine (G), alanine (A), isoleucine (I), methionine (M), and valine (V) and a mutation at R152, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at V148, the mutation being an aliphatic hydrophobic residue selected from glycine (G), alanine (A), leucine (L), isoleucine (I), and methionine (M).

In some embodiments, the mutant IFN-β comprises SEQ ID NO: 178 and a mutation at V148, the mutation being an aliphatic hydrophobic residue selected from glycine (G), alanine (A), leucine (L), isoleucine (I), methionine (M), and valine (V) and a mutation at R152, the mutation being an aliphatic hydrophobic residue selected from glycine (G), alanine (A), leucine (L), isoleucine (I), methionine (M), and valine (V).

In some embodiments, the mutant IFN-β comprises SEQ ID NO: 178 and a mutation at Y155, the mutation being an aliphatic hydrophobic residue selected from glycine (G), alanine (A), leucine (L), isoleucine (I), methionine (M), and valine (V).

In some embodiments, the present technology relates to a chimeric protein or Fc-based chimeric protein complex comprising: (a) a modified IFN-β, having the amino acid sequence of SEQ ID NO: 178 and a mutation at position W22, wherein the mutation is an aliphatic hydrophobic residue; and (b) one or more targeting moieties, said targeting moieties comprising recognition domains which specifically bind to antigens or receptors of interest (e.g., FAP), the modified IFN-β and the one or more targeting moieties are optionally connected with one or more linkers. In some embodiments the mutation at position W22 is aliphatic hydrophobic residue is selected from G, A, L, I, M, and V. In some embodiments, the mutation at position W22 is G.

Additional illustrative IFN-β mutants are provided in PCT/EP2017/061544, the entire disclosure of which is incorporated by reference herein.

In some embodiments, the signaling agent is a wild type or modified interferon γ. In such embodiments, the modified interferon γ agent has reduced affinity and/or activity for the interferon-gamma receptor (IFNGR), i.e., IFNGR1 and IFNGR2 chains. In some embodiments, the modified interferon γ agent has substantially reduced or ablated affinity and/or activity for the interferon-gamma receptor (IFNGR), i.e., IFNGR1 and/or IFNGR2 chains.

For example, the mutant IFN-γ can include a mutation, by way of non-limiting example, a truncation. In embodiments, the mutant IFN-γ has a truncation at the C-terminus, e.g. of about 5 to about 20 amino acid residues, or of about 16 amino acid residues, or of about 15 amino acid residues, or of about 14 amino acid residues, or of about 7 amino acid residues, or of about 5 amino acid residues. In embodiments, the mutant IFN-γ has one or more mutations at positions Q1, V5, E9, K12, H19, S20, V22, A23, D24, N25, G26, T27, L30, K108, H111, E112, I114, Q115, A118, E119, and K125. In embodiments, the mutant IFN-γ has one or more mutations are substitutions selected from V5E, S20E, V22A, A23G, A23F, D24G, G26Q, H111A, H111D, I114A, Q115A, and A118G. In embodiments, the mutant IFN-γ comprises the V22A mutation. In embodiments, the mutant IFN-γ comprises the A23G mutation. In embodiments, the mutant IFN-γ comprises the D24G mutation. In embodiments, the mutant IFN-γ comprises the H111A mutation or the H111D mutation. In embodiments, the mutant IFN-γ comprises the I114A mutation. In embodiments, the mutant IFN-γ comprises the Q115A mutation. In embodiments, the mutant IFN-γ comprises the A118G mutation. In embodiments, the mutant IFN-γ comprises the A23G mutation and the D24G mutation. In embodiments, the mutant IFN-γ comprises the I114A mutation and the A118G mutation. IFN-γ is shown in SEQ ID NO: 1043 below and all mutations are relative to SEQ ID NO: 1043:

```
                                      (SEQ ID NO: 1043)
MKYTSYILAFQLCIVLGSLGCYCQDPYVKEAENLKKYFNAGHSDVADNGTL

FLGILKNWKEESDRKIMQSQIVSFYFKLFKNFKDDQSIQKSVETIKEDMNV

KFFNSNKKKRDDFEKLTNYSVTDLNVQRKAIHELIQVMAELSPAAKTGKRK

RSQMLFRGRRASQ.
```

In an embodiment, the wildtype or modified signaling agent is consensus interferon. In some embodiments, the consensus interferon comprises the amino acid of SEQ ID NO: 179.

In some embodiments, the consensus interferon is modified to have a mutation at one or more amino acids at positions 33 and/or 145-155, such as amino acid positions 145, 146, 149, 150 and/or 154, with reference to SEQ ID NO: 179. In some embodiments, the consensus interferon is modified to have a mutation at one or more amino acids at positions 33 and/or 145-155, such as amino acid positions 145, 146, 149, 150 and/or 154, with reference to SEQ ID NO: 179, the substitutions optionally being hydrophobic and selected from alanine, valine, leucine, and isoleucine. In some embodiments, the consensus interferon mutant comprises one or more mutations selected from R33A, R145X₁, A146X₂, M149A, R150A, and L154A, wherein X₁ is selected from A, S, T, Y, L, and I, and wherein X₂ is selected from G, H, Y, K, and D with reference to SEQ ID NO: 179.

In an embodiment, the consensus interferon is modified to have a mutation at amino acid position 121 (i.e., K121), with reference to SEQ ID NO: 179. In an embodiment, the consensus interferon comprises a K121E mutation, with reference to SEQ ID NO: 179.

In an embodiment, the modified signaling agent comprises any of the consensus interferon variants as disclosed in U.S. Pat. Nos. 4,695,623, 4,897,471, 5,541,293, and 8,496,921, the entire contents of all of which are hereby incorporated by reference. For example, the consensus interferon variant may comprise the amino acid sequence of IFN-CON2 or IFN-CON3 as disclosed in U.S. Pat. Nos. 4,695,623, 4,897,471, and 5,541,293.

In some embodiments, the wildtype or modified signaling agent is vascular endothelial growth factor (VEGF). VEGF is a potent growth factor that plays major roles in physiological but also pathological angiogenesis, regulates vascular permeability and can act as a growth factor on cells expressing VEGF receptors. Additional functions include, among others, stimulation of cell migration in macrophage lineage and endothelial cells. Several members of the VEGF family of growth factors exist, as well as at least three receptors (VEGFR-1, VEGFR-2, and VEGFR-3). Members of the VEGF family can bind and activate more than one VEGFR type. For example, VEGF-A binds VEGFR-1 and-2, while VEGF-C can bind VEGFR-2 and-3. VEGFR-1 and-2 activation regulates angiogenesis while VEGFR-3 activation is associated with lymphangiogenesis. The major pro-angiogenic signal is generated from activation of VEGFR-2. VEGFR-1 activation has been reported to be possibly associated with negative role in angiogenesis. It has also been reported that VEGFR-1 signaling is important for progression of tumors in vivo via bone marrow-derived VEGFR-1 positive cells (contributing to formation of premetastatic niche in the bone). Several therapies based on VEGF-A directed/neutralizing therapeutic antibodies have been developed, primarily for use in treatment of various human tumors relying on angiogenesis. These are not without side effects though. This may not be surprising considering that these operate as general, non-cell/tissue specific VEGFNEGFR interaction inhibitors. Hence, it would be desirable to restrict VEGF (e.g., VEGF-A) NEGFR-2 inhibition to specific target cells (e.g., tumor vasculature endothelial cells).

In some embodiments, the VEGF is VEGF-A, VEGF-B, VEFG-C, VEGF-D, or VEGF-E and isoforms thereof including the various isoforms of VEGF-A such as VEGF121, VEGF121b, VEGF145, VEGF165, VEGF165b, VEGF189, and VEGF206. In some embodiments, the modified signaling agent has reduced affinity and/or activity for VEGFR-1 (Flt-1) and/or VEGFR-2 (KDR/Flk-1). In some embodiments, the modified signaling agent has substantially reduced or ablated affinity and/or activity for VEGFR-1 (Flt-1) and/or VEGFR-2 (KDR/Flk-1). In an embodiment, the modified signaling agent has reduced affinity and/or activity for VEGFR-2 (KDR/Flk-1) and/or substantially reduced or ablated affinity and/or activity for VEGFR-1 (Flt-1). Such an embodiment finds use, for example, in wound healing methods or treatment of ischmia-related diseases (without wishing to be bound by theory, mediated by VEGFR-2's effects on endothelial cell function and angiogenesis). In some embodiments, binding to VEGFR-1 (Flt-1), which is linked to cancers and pro-inflammatory activities, is avoided. In some embodiments, VEGFR-1 (Flt-1) acts a decoy receptor and therefore substantially reduces or ablates affinity at this receptor avoids sequestration of the therapeutic agent. In an embodiment, the modified signaling agent has substantially reduced or ablated affinity and/or activity for VEGFR-1 (Flt-1) and/or substantially reduced or ablated affinity and/or activity for VEGFR-2 (KDR/Flk-1). In some embodiments, the VEGF is VEGF-C or VEGF-D. In such embodiments, the modified signaling agent has reduced affinity and/or activity for VEGFR-3. Alternatively, the modified signaling agent has substantially reduced or ablated affinity and/or activity for VEGFR-3.

Proangiogenic therapies are also important in various diseases (e.g. ischemic heart disease, bleeding etc.), and include VEGF-based therapeutics. Activation of VEGFR-2 is proangiogenic (acting on endothelial cells). Activation of VEFGR-1 can cause stimulation of migration of inflammatory cells (including, for example, macrophages) and lead to inflammation associated hypervascular permeability. Activation of VEFGR-1 can also promote bone marrow associated tumor niche formation. Thus, VEGF based therapeutic selective for VEGFR-2 activation would be desirable in this case. In addition, cell specific targeting, e.g. to endothelial cells, would be desirable.

In some embodiments, the modified signaling agent has reduced affinity and/or activity (e.g. antagonistic) for VEGFR-2 and/or has substantially reduced or ablated affinity and/or activity for VEGFR-1. When targeted to tumor vasculature endothelial cells via a targeting moiety that binds to a tumor endothelial cell marker (e.g. PSMA and others), such construct inhibits VEGFR-2 activation specifically on such marker-positive cells, while not activating VEGFR-1 en route and on target cells (if activity ablated), thus eliminating induction of inflammatory responses, for example. This would provide a more selective and safe anti-angiogenic therapy for many tumor types as compared to VEGF-A neutralizing therapies.

In some embodiments, the modified signaling agent has reduced affinity and/or activity (e.g. agonistic) for VEGFR-2 and/or has substantially reduced or ablated affinity and/or activity for VEGFR-1. Through targeting to vascular endothelial cells, such construct, in some embodiments, promotes angiogenesis without causing VEGFR-1 associated induction of inflammatory responses. Hence, such a construct would have targeted proangiogenic effects with substantially reduced risk of side effects caused by systemic activation of VEGFR-2 as well as VEGFR-1.

In an illustrative embodiment, the wildtype or modified signaling agent is VEGF165 (wild type), which has the amino acid sequence: of SEQ ID NO: 180.

In another illustrative embodiment, the wildtype or modified signaling agent is VEGF165b (wild type), which has the amino acid sequence of SEQ ID NO: 181.

In these embodiments, the modified signaling agent has a mutation at amino acid 183 (e.g., a substitution mutation at 183, e.g., 183K, 183R, or 183H). Without wishing to be bound by theory, it is believed that such mutations may result in reduced receptor binding affinity. See, for example, U.S. Pat. No. 9,078,860, the entire contents of which are hereby incorporated by reference.

In an embodiment, the wildtype or modified signaling agent is TNF-α. TNF is a pleiotropic cytokine with many diverse functions, including regulation of cell growth, differentiation, apoptosis, tumorigenesis, viral replication, autoimmunity, immune cell functions and trafficking, inflammation, and septic shock. It binds to two distinct membrane receptors on target cells: TNFR1 (p55) and TNFR2 (p75). TNFR1 exhibits a very broad expression pattern whereas TNFR2 is expressed preferentially on certain populations of lymphocytes, Tregs, endothelial cells, certain neurons, microglia, cardiac myocytes and mesenchymal stem cells. Very distinct biological pathways are activated in response to receptor activation, although there is also some overlap. As a general rule, without wishing to be bound by theory, TNFR1 signaling is associated with induction of apoptosis (cell death) and TNFR2 signaling is associated with activation of cell survival signals (e.g. activation of NFκB pathway).

Administration of TNF is systemically toxic, and this is largely due to TNFR1 engagement. However, it should be noted that activation of TNFR2 is also associated with a broad range of activities and, as with TNFR1, in the context of developing TNF based therapeutics, control over TNF targeting and activity is important.

In some embodiments, the modified signaling agent has reduced affinity and/or activity for TNFR1 and/or TNFR2. In some embodiments, the modified signaling agent has substantially reduced or ablated affinity and/or activity for TNFR1 and/or TNFR2. TNFR1 is expressed in most tissues, and is involved in cell death signaling while, by contrast, TNFR2 is involved in cell survival signaling. Accordingly, in embodiments directed to methods of treating cancer, the modified signaling agent has reduced affinity and/or activity for TNFR1 and/or substantially reduced or ablated affinity and/or activity for TNFR2. In these embodiments, the chimeric proteins or Fc-based chimeric protein complex may be targeted to a cell for which apoptosis is desired, e.g. a tumor cell or a tumor vasculature endothelial cell. In embodiments directed to methods of promoting cell survival, for example, in neurogenesis for the treatment of neurodegenerative disorders, the modified signaling agent has reduced affinity and/or activity for TNFR2 and/or substantially reduced or ablated affinity and/or activity for TNFR1. Stated another way, the present chimeric proteins or Fc-based chimeric protein complex, in some embodiments, comprise modified TNF-a agent that allows of favoring either death or survival signals.

In some embodiments, the chimeric protein or Fc-based chimeric protein complex has a modified TNF having reduced affinity and/or activity for TNFR1 and/or substantially reduced or ablated affinity and/or activity for TNFR2. Such a chimera or Fc-based chimeric protein complex, in some embodiments, is a more potent inducer of apoptosis as compared to a wild type TNF and/or a chimera or Fc-based chimeric protein complex bearing only mutation(s) causing reduced affinity and/or activity for TNFR1. Such a chimera or Fc-based chimeric protein complex, in some embodiments, finds use in inducing tumor cell death or a tumor vasculature endothelial cell death (e.g. in the treatment of cancers). Also, in some embodiments, these chimeras or Fc-based chimeric protein complex avoid or reduce activation of Treg cells via TNFR2, for example, thus, further supporting TNFR1-mediated antitumor activity in vivo.

In some embodiments, the chimeric protein or Fc-based chimeric protein complex has a modified TNF having reduced affinity and/or activity for TNFR2 and/or substantially reduced or ablated affinity and/or activity for TNFR1. Such a chimera or Fc-based chimeric protein complex, in some embodiments, is a more potent activator of cell survival in some cell types, which may be a specific therapeutic objective in various disease settings, including without limitation, stimulation of neurogenesis. In addition, such a TNFR2-favoring chimeras or Fc-based chimeric protein complex also are useful in the treatment of autoimmune diseases (e.g. Crohn's, diabetes, MS, colitis etc. and many others described herein). In some embodiments, the chimera or Fc-based chimeric protein complex is targeted to auto-reactive T cells. In some embodiments, the chimera or Fc-based chimeric protein complex promotes Treg cell activation and indirect suppression of cytotoxic T cells.

In some embodiments, the chimera or Fc-based chimeric protein complex causes the death of auto-reactive T cells, e.g. by activation of TNFR2 and/or avoidance of TNFR1 (e.g. a modified TNF having reduced affinity and/or activity for TNFR2 and/or substantially reduced or ablated affinity and/or activity for TNFR1). Without wishing to be bound by theory these auto-reactive T cells, have their apoptosis/survival signals altered e.g. by NFκB pathway activity/signaling alterations. In some embodiments, the chimera or Fc-based chimeric protein complex causes the death of autoreactive T cells having lesions or modifications in the NFκB pathway, which underlie an imbalance of their cell death (apoptosis)/survival signaling properties and, optionally, altered susceptibility to certain death-inducing signals (e.g., TNFR2 activation).

In some embodiments, a TNFR2 based chimera or Fc-based chimeric protein complex has additional therapeutic applications in diseases, including various autoimmune diseases, heart disease, de-myelinating and neurodegenerative disorders, and infectious disease, among others.

In an embodiment, the wild type TNF-α has the amino acid sequence of: SEQ ID NO: 182.

In such embodiments, the modified TNF-α agent has mutations at one or more amino acid positions 29, 31, 32, 84, 85, 86, 87, 88, 89, 145, 146 and 147, which produces a modified TNF-α with reduced receptor binding affinity. See, for example, U.S. Pat. No. 7,993,636, the entire contents of which are hereby incorporated by reference.

In some embodiments, the modified human TNF-α moiety has mutations at one or more amino acid positions R32, N34, Q67, H73, L75, T77, S86, Y87, V91, I97, T105, P106, A109, P113, Y115, E127, N137, D143, A145, and E146, as described, for example, in WO/2015/007903, the entire contents of which is hereby incorporated by reference (numbering according to the human TNF sequence, Genbank accession number BAG70306, version BAG70306.1 GI: 197692685). In some embodiments, the modified human TNF-α moiety has substitution mutations selected from L29S, R32G, R32W, N34G, Q67G, H73G, L75G, L75A, L75S, T77A, S86G, S86T, Y87Q, Y87L, Y87A, Y87F, Y87H, V91G, V91A, I97A, I97Q, I97S, T105G, P106G, A109Y, P113G, Y115G, Y115A, E127G, N137G, D143N, A145G, A145R, A145T, E146D, E146K, and S147D. In an embodiment, the human TNF-α moiety has a mutation selected from Y87Q, Y87L, Y87A, Y87F, and Y87H. In another embodiment, the human TNF-α moiety has a mutation selected from I97A, I97Q, and I97S. In a further embodiment, the human TNF-α moiety has a mutation selected from Y115A and Y115G. In an embodiment, the human TNF-α moiety has an E146K mutation. In an embodiment, the human TNF-α moiety has an Y87H and an E146K mutation. In an embodiment, the human TNF-α moiety has an Y87H and an A145R mutation.

In an embodiment, the human TNF-α moiety has a R32W and a S86T mutation. In an embodiment, the human TNF-α moiety has a R32W and an E146K mutation. In an embodiment, the human TNF-α moiety has a L29S and a R32W mutation. In an embodiment, the human TNF-α moiety has a D143N and an A145R mutation. In an embodiment, the human TNF-α moiety has a D143N and an A145R mutation. In an embodiment, the human TNF-α moiety has an A145T, an E146D, and a S147D mutation. In an embodiment, the human TNF-α moiety has an A145T and a S147D mutation.

In some embodiments, the modified TNF-α agent has one or more mutations selected from N39Y, S147Y, and Y87H, as described in WO 2008/124086, the entire contents of which is hereby incorporated by reference.

In some embodiments, the modified human TNF-α moiety has mutations that provide receptor selectivity as described in PCT/IB2016/001668, the entire contents of which are hereby incorporated by reference. In some embodiments, the mutations to TNF are TNF-R1 selective. In some embodiments, the mutations to TNF which are TNF-R1 selective are at one or more of positions R32, S86, and E146. In some embodiments, the mutations to TNF which are TNF-R1 selective are one or more of R32W, S86T, and E146K. In some embodiments, the mutations to TNF which are TNF-R1 selective are one or more of R32W, R32W/S86T, R32W/E146K and E146K. In some embodiments, the mutations to TNF are TNF-R2 selective. In some embodiments, the mutations to TNF which are TNF-R2 selective are at one or more of positions A145, E146, and S147. In some embodiments, the mutations to TNF which are TNF-R2 selective are one or more of A145T, A145R, E146D, and S147D. In some embodiments, the mutations to TNF which are TNF-R2 selective are one or more of A145R, A145T/S147D, and A145T/E146D/S 147D.

In some embodiments, the wildtype or modified signaling agent is TNF-β. TNF-β forms a homotrimer or a heterotrimer with LT-β (LT-α1β2). In some embodiments, the modified signaling agent has substantially reduced or ablated affinity and/or activity for TNFR1 and/or TNFR2 and/or herpes virus entry mediator (HEVM) and/or LT-βR.

In an embodiment, the wild type TNF-β has the amino acid sequence of: SEQ ID NO: 183.

In such embodiments, the modified soluble agent may comprise mutations at one or more amino acids at positions 106-113, which produce a modified TNF-β with reduced receptor binding affinity to TNFR2. In an embodiment, the modified soluble agent has one or more substitution mutations at amino acid positions 106-113. In some embodiments, the substitution mutations are selected from Q107E, Q107D, S106D, 5106D, Q107R, Q107N, Q107E/S106E, Q107E/S106D, Q107D/S106E, and Q107D/S106D. In another embodiment, the modified soluble agent has an insertion of about 1 to about 3 amino acids at positions 106-113.

In some embodiments, the modified agent is a TNF family member (e.g. TNF-alpha, TNF-beta), which can be a single chain trimeric version as described in WO 2015/007903, the entire contents of which are incorporated by reference.

In some embodiments, the modified agent is a TNF family member (e.g. TNF-alpha, TNF-beta), which has reduced affinity and/or activity, i.e. antagonistic activity (e.g. natural antagonistic activity or antagonistic activity that is the result of one or more mutations, see, e.g., WO 2015/007520, the entire contents of which are hereby incorporated by reference) at TNFR1. In these embodiments, the modified agent is a TNF family member (e.g. TNF-alpha, TNF-beta), which also, optionally, has substantially reduced or ablated affinity and/or activity for TNFR2. In some embodiments, the modified agent is a TNF family member (e.g. TNF-alpha, TNF-beta) which has reduced affinity and/or activity, i.e. antagonistic activity (e.g. natural antagonistic activity or antagonistic activity that is the result of one or more mutations, see, e.g., WO 2015/007520, the entire contents of which are hereby incorporated by reference) at TNFR2. In these embodiments, the modified agent is a TNF family member (e.g. TNF-alpha, TNF-beta) which also, optionally, has substantially reduced or ablated affinity and/or activity for TNFR1. The constructs of such embodiments find use in, for example, methods of dampening TNF response in a cell specific manner. In some embodiments, the antagonistic TNF family member (e.g. TNF-alpha, TNF-beta) is a single chain trimeric version as described in WO 2015/007903.

In some embodiments, the wildtype or modified signaling agent is TRAIL. In some embodiments, the modified TRAIL agent has reduced affinity and/or activity for DR4 (TRAIL-RI) and/or DR5 (TRAIL-RII) and/or DcR1 and/or DcR2. In some embodiments, the modified TRAIL agent has substantially reduced or ablated affinity and/or activity for DR4 (TRAIL-RI) and/or DR5 (TRAIL-RII) and/or DcR1 and/or DcR2.

In an embodiment, the wild type TRAIL has the amino acid sequence of: SEQ ID NO: 184.

In such embodiments, the modified TRAIL agent may comprise a mutation at amino acid positions T127-R132, E144-R149, E155-H161, Y189-Y209, T214-1220, K224-A226, W231, E236-L239, E249-K251, T261-H264 and H270-E271 (Numbering based on the human sequence, Genbank accession number NP_003801, version 10 NP_003801.1, GI: 4507593; see above).

In some embodiments, the modified TRAIL agent may comprise one or more mutations that substantially reduce its affinity and/or activity for TRAIL-R1. In such embodiments, the modified TRAIL agent may specifically bind to TRIL-R2. Illustrative mutations include mutations at one or more amino acid positions Y189, R191, Q193, H264, 1266, and D267. For example, the mutations may be one or more of Y189Q, R191K, Q193R, H264R, 1266L and D267Q. In an embodiment, the modified TRAIL agent comprises the mutations Y189Q, R191K, Q193R, H264R, 1266L and D267Q.

In some embodiments, the modified TRAIL agent may comprise one or more mutations that substantially reduce its affinity and/or activity for TRAIL-R2. In such embodiments, the modified TRAIL agent may specifically bind to TRIL-R1. Illustrative mutations include mutations at one or more amino acid positions G131, R149, S159, N199, K201, and S215. For example, the mutations may be one or more of G131R, R1491, S159R, N199R, K201H, and S215D. In an embodiment, the modified TRAIL agent comprises the mutations G131R, R1491, S159R, N199R, K201H, and S215D. Additional TRAIL mutations are described in, for example, Trebing et al., (2014) Cell Death and Disease, 5:e1035, the entire disclosure of which is hereby incorporated by reference.

In some embodiments, the wildtype or modified signaling agent is TGFα. In such embodiments, the modified TGFα agent has reduced affinity and/or activity for the epidermal growth factor receptor (EGFR). In some embodiments, the modified TGFα agent has substantially reduced or ablated affinity and/or activity for the epidermal growth factor receptor (EGFR).

In some embodiments, the wildtype or modified signaling agent is TGFβ. In such embodiments, the modified signaling agent has reduced affinity and/or activity for TGFBR1 and/or TGFBR2. In some embodiments, the modified signaling agent has substantially reduced or ablated affinity and/or activity for TGFBR1 and/or TGFBR2. In some embodiments, the modified signaling agent optionally has reduced or substantially reduced or ablated affinity and/or activity for TGFBR3 which, without wishing to be bound by theory, may act as a reservoir of ligand for TGF-beta receptors. In some embodiments, the TGFβ favors TGFBR1 over TGFBR2 or TGFBR2 over TGFBR1. Similarly, LAP, without wishing to be bound by theory, may act as a reservoir of ligand for TGF-beta receptors. In some embodiments, the modified signaling agent has reduced affinity and/or activity for TGFBR1 and/or TGFBR2 and/or substantially reduced or ablated affinity and/or activity for Latency Associated Peptide (LAP). In some embodiments, such chimeras or Fc-based chimeric protein complex find use in Camurati-Engelmann disease, or other diseases associated with inappropriate TGFβ signaling.

In some embodiments, the modified agent is a TGF family member (e.g. TGFα, TGFβ), which has reduced affinity and/or activity, i.e. antagonistic activity (e.g. natural antagonistic activity or antagonistic activity that is the result of one or more mutations, see, e.g., WO 2015/007520, the entire contents of which are hereby incorporated by reference) at one or more of TGFBR1, TGFBR2, TGFBR3. In these embodiments, the modified agent is a TGF family member (e.g. TGFα, TGFβ) which also, optionally, has substantially reduced or ablated affinity and/or activity at one or more of TGFBR1, TGFBR2, TGFBR3.

In some embodiments, the modified agent is a TGF family member (e.g. TGFα, TGFβ) which has reduced affinity and/or activity, i.e. antagonistic activity (e.g. natural antagonistic activity or antagonistic activity that is the result of one or more mutations, see, e.g., WO 2015/007520, the entire contents of which are hereby incorporated by reference) at TGFBR1 and/or TGFBR2. In these embodiments, the modified agent is a TGF family member (e.g. TGFα, TGFβ) which also, optionally, has substantially reduced or ablated affinity and/or activity at TGFBR3.

In some embodiments, the wildtype or modified signaling agent is an interleukin. In an embodiment, the wildtype or modified signaling agent is IL-1. In some embodiments, the wildtype or modified signaling agent is IL-1α or IL-1β. In some embodiments, the modified signaling agent has reduced affinity and/or activity for IL-1R1 and/or IL-1RAcP. In some embodiments, the modified signaling agent has substantially reduced or ablated affinity and/or activity for IL-1R1 and/or IL-1RAcP.

In some embodiments, the modified signaling agent has reduced affinity and/or activity for IL-1R2. In some embodiments, the modified signaling agent has substantially reduced or ablated affinity and/or activity for IL-1R2. For instance, in some embodiments, the present modified IL-1β agents avoid interaction at IL-1R2 and therefore substantially reduce its function as a decoy and/or sink for therapeutic agents.

In an embodiment, the wild type IL-1β has the amino acid sequence of: SEQ ID NO: 185.

IL-1β is a proinflammatory cytokine and an important immune system regulator. It is a potent activator of CD4 T cell responses, increases proportion of Th17 cells and expansion of IFNγ and IL-4 producing cells. IL-1β is also a potent regulator of CD8+ T cells, enhancing antigen-specific CD8+ T cell expansion, differentiation, migration to periphery and memory. IL-1β receptors comprise IL-1R1 and IL-1R2. Binding to and signaling through the IL-1R1 constitutes the mechanism whereby IL-1 mediates many of its biological (and pathological) activities. IL1-R2 can function as a decoy receptor, thereby reducing IL-1 availability for interaction and signaling through the IL-1R1.

In some embodiments, the modified IL-1β has reduced affinity and/or activity (e.g. agonistic activity) for IL-1R1. In some embodiments, the modified IL-1 has substantially reduced or ablated affinity and/or activity for IL-1R2. In such embodiments, there is restorable IL-1β/IL-1R1 signaling and prevention of loss of therapeutic chimeras at IL-R2 and therefore a reduction in dose of IL-1β that is required (e.g. relative to wild type or a chimera bearing only an attenuation mutation for IL-R1). Such constructs find use in, for example, methods of treating cancer, including, for example, stimulating the immune system to mount an anti-cancer response.

In some embodiments, the modified IL-1β has reduced affinity and/or activity (e.g. antagonistic activity, e.g. natural antagonistic activity or antagonistic activity that is the result of one or more mutations, see, e.g., WO 2015/007520, the entire contents of which are hereby incorporated by reference) for IL-1R1. In some embodiments, the modified IL-1β has substantially reduced or ablated affinity and/or activity for IL-1R2. In such embodiments, there is the IL-1β/IL-1R1 signaling is not restorable and prevention of loss of therapeutic chimeras at IL-R2 and therefore a reduction in dose of IL-1β that is required (e.g. relative to wild type or a chimera bearing only an attenuation mutation for IL-R1). Such constructs find use in, for example, methods of treating autoimmune diseases, including, for example, suppressing the immune system.

In such embodiments, the modified signaling agent has a deletion of amino acids 52-54 which produces a modified human IL-1β with reduced binding affinity for type I IL-1R and reduced biological activity. See, for example, WO 1994/000491, the entire contents of which are hereby incorporated by reference. In some embodiments, the modified human IL-1β has one or more substitution mutations selected from A117G/P118G, R120X, L122A, T125G/L126G, R127G, Q130X, Q131G, K132A, S137G/Q138Y, L145G, H146X, L145A/L147A, Q148X, Q148G/Q150G, Q150G/D151A, M152G, F162A, F162A/Q164E, F166A, Q164E/E167K, N169G/D170G, I172A, V174A, K208E, K209X, K209A/K210A, K219X, E221X, E221 S/N224A, N224S/K225S, E244K, N245Q (where X can be any change in amino acid, e.g., a non-conservative change), which exhibit reduced binding to IL-1R, as described, for example, in WO 2015/007542 and WO/2015/007536, the entire contents of which is hereby incorporated by reference (numbering base on the human IL-1β sequence, Genbank accession number NP_000567, version NP-000567.1, GI: 10835145). In some embodiments, the modified human IL-1β may have one or more mutations selected from R120A, R120G, Q130A, Q130W, H146A, H146G, H146E, H146N, H146R, Q148E, Q148G, Q148L, K209A, K209D, K219S, K219Q, E221S and E221K. In an embodiment, the modified human IL-1β comprises the mutations Q131G and Q148G. In an embodiment, the modified human IL-1β comprises the mutations Q148G and K208E. In an embodiment, the modified human IL-1β comprises the mutations R120G and Q131G. In an embodiment, the modified human IL-1β comprises the mutations R120G and H146A. In an embodiment, the modified human IL-1β comprises the mutations R120G and H146N. In an embodiment, the modified human IL-1β comprises the mutations R120G and H146R. In an embodiment, the modified human IL-1β comprises the mutations R120G and H146E. In an embodiment, the modified human IL-1β comprises the mutations R120G and H146G. In an embodiment, the modified human IL-1β comprises the mutations R120G and K208E. In an embodiment, the modified human IL-1β comprises the mutations R120G, F162A, and Q164E.

In some embodiments, the wildtype or modified signaling agent is IL-2. In such an embodiment, the modified signaling agent has reduced affinity and/or activity for IL-2Rα and/or IL-2Rβ and/or IL-2Rγ. In some embodiments, the modified signaling agent has reduced affinity and/or activity for IL-2Rβ and/or IL-2Rγ. In some embodiments, the modified signaling agent has substantially reduced or ablated affinity and/or activity for IL-2Rα. Such embodiments may be relevant for treatment of cancer, for instance when the modified IL-2 is agonistic at IL-2Rβ and/or IL-2Rγ. For instance, the present constructs may favor attenuated activation of CD8+ T cells (which can provide an anti-tumor effect), which have IL2 receptors β and γ and disfavor Tregs (which can provide an immune suppressive, pro-tumor effect), which have IL2 receptors α, β, and γ. Further, in some embodiments, the preference for IL-2Rβ and/or IL-2Rγ over IL-2Rα avoids IL-2 side effects such as pulmonary edema. Also, IL-2-based chimeras or Fc-based chimeric protein complex are useful for the treatment of autoimmune diseases, for instance when the modified IL-2 is antagonistic (e.g. natural antagonistic activity or antagonistic activity that is the result of one or more mutations, see, e.g., WO 2015/007520, the entire contents of which are hereby incorporated by reference) at IL-2Rβ and/or IL-2Rγ. For instance, the present constructs may favor attenuated suppression of CD8+ T cells (and therefore dampen the immune response), which have IL2 receptors β and γ and disfavor Tregs which have IL2 receptors α, β, and γ. Alternatively, in some embodiments, the chimeras or Fc-based chimeric protein complex bearing IL-2 favor the activation of Tregs, and therefore immune suppression, and activation of disfavor of CD8+ T cells. For instance, these constructs find use in the treatment of diseases or diseases that would benefit from immune suppression, e.g. autoimmune disorders.

In some embodiments, the chimeric protein or Fc-based chimeric protein complex has targeting moieties as described herein directed to FAP+ dendritic cells as well as a modified IL-2 agent having reduced affinity and/or activity for IL-2Rβ, and/or IL-2Rγ and/or substantially reduced or ablated affinity and/or activity for IL-2Rα. In some embodiments, these constructs provide targeted FAP+ dendritic cell activity and are generally inactive (or have substantially reduced activity) towards Treg cells. In some embodiments, such constructs have enhanced immune stimulatory effect compared to wild type IL-2 (e.g., without wishing to be bound by theory, by not stimulating Tregs), whilst eliminating or reducing the systemic toxicity associated with IL-2.

In some embodiments, the wild type IL-2 has the amino acid sequence of: SEQ ID NO: 186.

In such embodiments, the modified IL-2 agent has one or more mutations at amino acids L72 (L72G, L72A, L725, L72T, L72Q, L72E, L72N, L72D, L72R, or L72K), F42 (F42A, F42G, F42S, F42T, F42Q, F42E, F42N, F42D, F42R, or F42K) and Y45 (Y45A, Y45G, Y45S, Y45T, Y45Q, Y45E, Y45N, Y45D, Y45R or Y45K). Without wishing to be bound by theory, it is believed that these modified IL-2 agents have reduced affinity for the high-affinity IL-2 receptor and preserves affinity to the intermediate-affinity IL-2 receptor, as compared to the wild-type IL-2. See, for example, US Patent Publication No. 2012/0244112, the entire contents of which are hereby incorporated by reference.

In some embodiments, the modified IL-2 agent has one or more mutations at amino acids R38, F42, Y45, and E62. For example, the modified IL-2 agent may comprise one or more of R38A, F42A, Y45A, and E62A. In some embodiments, the modified IL-2 agent may comprise a mutation at C125. For example, the mutation may be C125S. In such embodiments, the modified IL-2 agent may have substantially reduced affinity and/or activity for IL-2Rα, as described in, for example, Carmenate et al. (2013) The Journal of Immunology, 190:6230-6238, the entire disclosure of which is hereby incorporated by reference. In some embodiments, the modified IL-2 agent with mutations at R38, F42, Y45, and/or E62 is able to induce an expansion of effector cells including CD8+ T cells and NK cells but not Treg cells. In some embodiments, the modified IL-2 agent with mutations at R38, F42, Y45, and/or E62 is less toxic than wildtype IL-2 agents. A chimeric protein or Fc-based chimeric protein complex comprising the modified IL-2 agent with substantially reduced affinity and/or activity for IL-2Rα may find application in oncology for example.

In other embodiments, the modified IL-2 agent may have substantially reduced affinity and/or activity for IL-2Rβ, as described in, for example, WO 2016/025385, the entire disclosure of which is hereby incorporated by reference. In such embodiments, the modified IL-2 agent may induce an expansion of Treg cells but not effector cells such as CD8+ T cells and NK cells. A chimeric protein or Fc-based chimeric protein complex comprising the modified IL-2 agent with substantially reduced affinity and/or activity for IL-2Rβ may find application in the treatment of autoimmune disease for example. In some embodiments, the modified IL-2 agent may comprise one or more mutations at amino acids N88, D20, and/or A126. For example, the modified IL-2 agent may comprise one or more of N88R, N88I, N88G, D20H, Q126L, and Q126F.

In some embodiments, the modified IL-2 agent may comprise a mutation at D109 or C125. For example, the mutation may be D109C or C125S. In some embodiments, the modified IL-2 with a mutation at D109 or C125 may be utilized for attachment to a PEG moiety.

In some embodiments, the wildtype or modified signaling agent is IL-3. In some embodiments, the modified signaling agent has reduced affinity and/or activity for the IL-3 receptor, which is a heterodimer with a unique alpha chain paired with the common beta (beta c or CD131) subunit. In some embodiments, the modified signaling agent has substantially reduced or ablated affinity and/or activity for the IL-3 receptor, which is a heterodimer with a unique alpha chain paired with the common beta (beta c or CD131) subunit.

In some embodiments, the wildtype or modified signaling agent is IL-4. In such an embodiment, the modified signaling agent has reduced affinity and/or activity for type 1 and/or type 2 IL-4 receptors. In such an embodiment, the modified signaling agent has substantially reduced or ablated affinity and/or activity for type 1 and/or type 2 IL-4 receptors. Type 1 IL-4 receptors are composed of the IL-4Rα subunit with a common γ chain and specifically bind IL-4. Type 2 IL-4 receptors include an IL-4Rα subunit bound to a different subunit known as IL-13Rα1. In some embodiments, the modified signaling agent has substantially reduced or ablated affinity and/or activity the type 2 IL-4 receptors.

In some embodiments, the wild type IL-4 has the amino acid sequence of: SEQ ID NO: 187.

In such embodiments, the modified IL-4 agent has one or more mutations at amino acids R121 (R121A, R121D, R121E, R121F, R121H, R121I, R121K, R121N, R121P, R121T, R121W), E122 (E122F), Y124 (Y124A, Y124Q, Y124R, Y124S, Y124T), and S125 (S125A). Without wishing to be bound by theory, it is believed that these modified IL-4 agents maintain the activity mediated by the type I receptor, but significantly reduces the biological activity mediated by the other receptors. See, for example, U.S. Pat. No. 6,433,157, the entire contents of which are hereby incorporated by reference.

In some embodiments, the wildtype or modified signaling agent is IL-6. IL-6 signals through a cell-surface type I cytokine receptor complex including the ligand-binding IL-6R chain (CD126), and the signal-transducing component gp130. IL-6 may also bind to a soluble form of IL-6R (sIL-6R), which is the extracellular portion of IL-6R. The sIL-6R/IL-6 complex may be involved in neurites outgrowth and survival of neurons and, hence, may be important in nerve regeneration through remyelination. Accordingly, in some embodiments, the modified signaling agent has reduced affinity and/or activity for IL-6R/gp130 and/or sIL-6R. In some embodiments, the modified signaling agent has substantially reduced or ablated affinity and/or activity for IL-6R/gp130 and/or sIL-6R.

In some embodiments, the wild type IL-6 has the amino acid sequence of SEQ ID NO: 188.

In such embodiments, the modified signaling agent has one or more mutations at amino acids 58, 160, 163, 171 or 177. Without wishing to be bound by theory, it is believed that these modified IL-6 agents exhibit reduced binding affinity to IL-6R-alpha and reduced biological activity. See, for example, WO 97/10338, the entire contents of which are hereby incorporated by reference.

In some embodiments, the wildtype or modified signaling agent is IL-10. In such an embodiment, the modified signaling agent has reduced affinity and/or activity for IL-10 receptor-1 and IL-10 receptor-2. In some embodiments, the modified signaling agent has substantially reduced or ablated affinity and/or activity for IL-10 receptor-1 and IL-10 receptor-2

In some embodiments, the wildtype or modified signaling agent is IL-11. In such an embodiment, the modified signaling agent has reduced affinity and/or activity for IL-11Rα and/or IL-11Rβ and/or gp130. In such an embodiment, the modified signaling agent has substantially reduced or ablated affinity and/or activity for IL-11Rα and/or IL-11Rβ and/or gp130.

In some embodiments, the wildtype or modified signaling agent is IL-12. In such an embodiment, the modified signaling agent has reduced affinity and/or activity for IL-12Rβ1 and/or IL-12Rβ2. In such an embodiment, the modified signaling agent has substantially reduced or ablated affinity and/or activity for IL-12Rβ1 and/or IL-12Rβ2.

In some embodiments, the wildtype or modified signaling agent is IL-13. In such an embodiment, the modified signaling agent has reduced affinity and/or activity for the IL-4 receptor (IL-4Rα) and IL-13Rα1. In some embodiments, the modified signaling agent has substantially reduced or ablated affinity and/or activity for IL-4 receptor (IL-4Rα) or IL-13Rα1.

In some embodiments, the wild type IL-13 has the amino acid sequence: SEQ ID NO: 189.

In such embodiments, the modified IL-13 agent has one or more mutations at amino acids 13, 16, 17, 66, 69, 99, 102, 104, 105, 106, 107, 108, 109, 112, 113 and 114. Without wishing to be bound by theory, it is believed that these modified IL-13 agents exhibit reduced biological activity. See, for example, WO 2002/018422, the entire contents of which are hereby incorporated by reference.

In an embodiment, the signaling agent is a wild type or modified IL-15. In embodiments, the modified IL-15 has reduced affinity and/or activity for interleukin 15 receptor.

In an embodiment, the wild type IL-15 has the amino acid sequence of:

```
                              (SEQ ID NO: 1044)
NWVNVISDLKKIEDLIQSMHIDATLYTESDVHPSCKVTAMKCFLLELQVIS
LESGDASIHDTVENLIILANNSLSSNGNVTESGCKECEELEEKNIKEFLQS
FVHIVQMFINTS.
```

In such embodiments, the modified IL-15 agent has one or more mutations at amino acids S7, D8, K10, K11, E46, L47, V49, I50, D61, N65, L66, I67, I68, L69, N72, Q108 with respect to SEQ ID NO: 1044.

In some embodiments, the wildtype or modified signaling agent is IL-18. In some embodiments, the modified signaling agent has reduced affinity and/or activity for IL-18Rα and/or IL-18Rβ. In some embodiments, the modified signaling agent has substantially reduced or ablated affinity and/or activity for IL-18Rα and/or IL-18Rβ. In some embodiments, the modified signaling agent has substantially reduced or ablated affinity and/or activity for IL-18Rα type II, which is an isoform of IL-18Rα that lacks the TIR domain required for signaling.

In some embodiments, the wild type IL-18 has the amino acid sequence: SEQ ID NO: 190.

In such embodiments, the modified IL-18 agent may comprise one or more mutations in amino acids or amino acid regions selected from Y37-K44, R49-Q54, D59-R63, E67-C74, R80, M87-A97, N 27-K129, Q139-M149, K165-K171, R183 and Q190-N191, as described in WO/2015/007542, the entire contents of which are hereby incorporated by reference (numbering based on the human IL-18 sequence, Genbank accession number AAV38697, version AAV38697.1, GI: 54696650).

In some embodiments, the wildtype or modified signaling agent is IL-33. In such an embodiment, the modified signaling agent has reduced affinity and/or activity for the ST-2 receptor and IL-1RAcP. In some embodiments, the modified signaling agent has substantially reduced or ablated affinity and/or activity for the ST-2 receptor and IL-1RAcP.

In some embodiments, the wild type IL-33 has the amino acid sequence of: SEQ ID NO: 191.

In such embodiments, the modified IL-33 agent may comprise one or more mutations in amino acids or amino acid regions selected from 1113-Y122, 5127-E139, E144-D157, Y163-M183, E200, Q215, L220-C227 and T260-E269, as described in WO/2015/007542, the entire contents of which are hereby incorporated by reference (numbering based on the human sequence, Genbank accession number NP_254274, version NP_254274.1, GI:15559209).

In some embodiments, the wildtype or modified signaling agent is epidermal growth factor (EGF). EGF is a member of a family of potent growth factors. Members include EGF, HB-EGF, and others such as TGFalpha, amphiregulin, neuregulins, epiregulin, betacellulin. EGF family receptors include EGFR (ErbB1), ErbB2, ErbB3 and ErbB4. These may function as homodimeric and/or heterodimeric receptor subtypes. The different EGF family members exhibit differential selectivity for the various receptor subtypes. For example, EGF associates with ErbB1/ErbB1, ErbB1/ErbB2, ErbB4/ErbB2 and some other heterodimeric subtypes. HB-EGF has a similar pattern, although it also associates with ErbB4/4. Modulation of EGF (EGF-like) growth factor signaling, positively or negatively, is of considerable therapeutic interest. For example, inhibition of EGFRs signaling is of interest in the treatment of various cancers where EGFR signaling constitutes a major growth-promoting signal. Alternatively, stimulation of EGFRs signaling is of therapeutic interest in, for example, promoting wound healing (acute and chronic), oral mucositis (a major side effect of various cancer therapies, including, without limitation radiation therapy).

In some embodiments, the modified signaling agent has reduced affinity and/or activity for ErbB1, ErbB2, ErbB3, and/or ErbB4. Such embodiments find use, for example, in methods of treating wounds. In some embodiments, the modified signaling agent binds to one or more ErbB1, ErbB2, ErbB3, and ErbB4 and antagonizes the activity of the receptor. In such embodiments, the modified signaling agent has reduced affinity and/or activity for ErbB1, ErbB2, ErbB3, and/or ErbB4 that allows for the activity of the receptor to be antagonized in an attenuated fashion. Such embodiments find use in, for example, treatments of cancer. In an embodiment, the modified signaling agent has reduced affinity and/or activity for ErbB1. ErbB1 is the therapeutic target of kinase inhibitors most have side effects because they are not very selective (e.g., gefitinib, erlotinib, afatinib, brigatinib and icotinib). In some embodiments, attenuated antagonistic ErbB1 signaling is more on-target and has less side effects than other agents targeting receptors for EGF.

In some embodiments, the modified signaling agent has reduced affinity and/or activity (e.g. antagonistic e.g. natural antagonistic activity or antagonistic activity that is the result of one or more mutations, see, e.g., WO 2015/007520, the entire contents of which are hereby incorporated by reference) for ErbB1 and/or substantially reduced or ablated affinity and/or activity for ErbB4 or other subtypes it may interact with. Through specific targeting via the targeting moiety, cell-selective suppression (antagonism e.g. natural antagonistic activity or antagonistic activity that is the result of one or more mutations, see, e.g., WO 2015/007520, the entire contents of which are hereby incorporated by reference) of ErbB1/ErbB1 receptor activation would be achieved while not engaging other receptor subtypes potentially associated with inhibition-associated side effects. Hence, in contrast to EGFR kinase inhibitors, which inhibit EGFR activity in all cell types in the body, such a construct would provide a cell-selective (e.g., tumor cell with activated EGFR signaling due to amplification of receptor, overexpression etc.) anti-EGFR (ErbB1) drug effect with reduced side effects.

In some embodiments, the modified signaling agent has reduced affinity and/or activity (e.g. agonistic) for ErbB4 and/or other subtypes it may interact with. Through targeting to specific target cells through the targeting moiety, a selective activation of ErbB1 signaling is achieved (e.g. epithelial cells). Such a construct finds use, in some embodiments, in the treatment of wounds (promoting would healing) with reduced side effects, especially for treatment of chronic conditions and application other than topical application of a therapeutic (e.g. systemic wound healing).

In an embodiment, the wildtype or modified signaling agent is insulin or insulin analogs. In some embodiments, the modified insulin or insulin analog has reduced affinity and/or activity for the insulin receptor and/or IGF1 or IGF2 receptor. In some embodiments, the modified insulin or insulin analog has substantially reduced or ablated affinity and/or activity for the insulin receptor and/or IGF1 or IGF2 receptor. Attenuated response at the insulin receptor allows for the control of diabetes, obesity, metabolic disorders and the like while directing away from IGF1 or IGF2 receptor avoids pro-cancer effects.

In an embodiment, the wildtype or modified signaling agent is insulin-like growth factor-I or insulin-like growth factor-II (IGF-1 or IGF-2). In an embodiment, the modified signaling agent is IGF-1. In such an embodiment, the modified signaling agent has reduced affinity and/or activity for the insulin receptor and/or IGF1 receptor. In an embodiment, the modified signaling agent may bind to the IGF1 receptor and antagonize the activity of the receptor. In such an embodiment, the modified signaling agent has reduced affinity and/or activity for IGF1 receptor that allows for the activity of the receptor to be antagonized in an attenuated fashion. In some embodiments, the modified signaling agent has substantially reduced or ablated affinity and/or activity for the insulin receptor and/or IGF1 receptor. In some embodiments, the modified signaling agent has reduced affinity and/or activity for IGF2 receptor that allows for the activity of the receptor to be antagonized in an attenuated fashion. In an embodiment, the modified signaling agent has substantially reduced or ablated affinity and/or activity for the insulin receptor and accordingly does not interfere with insulin signaling. In some embodiments, this applies to cancer treatment. In some embodiments, the present agents may prevent IR isoform A from causing resistance to cancer treatments.

In an embodiment, the wildtype or modified signaling agent is EPO. In various embodiments, the modified EPO agent has reduced affinity and/or activity for the EPO receptor (EPOR) receptor and/or the ephrin receptor (EphR) relative to wild type EPO or other EPO based agents described herein. In some embodiments, the modified EPO agent has substantially reduced or ablated affinity and/or activity for the EPO receptor (EPOR) receptor and/or the Eph receptor (EphR). Illustrative EPO receptors include, but are not limited to, an EPOR homodimer or an EPOR/CD131 heterodimer. Also included as an EPO receptor is beta-common receptor ($\beta$cR). Illustrative Eph receptors include, but are not limited to, EPHA1, EPHA2, EPHA3, EPHA4, EPHA5, EPHA6, EPHA7, EPHA8, EPHA9, EPHA10, EPHB1, EPHB2, EPHB3, EPHB4, EPHB5, and EPHB6. In some embodiments, the modified EPO protein comprises one or more mutations that cause the EPO protein to have reduced affinity for receptors that comprise one or more different EPO receptors or Eph receptors (e.g., heterodimer, heterotrimers, etc., including by way of non-limitation: EPOR-EPHB4, EPOR-$\beta$cR-EPOR). Also provided are the receptors of EP Patent Publication No. 2492355 the entire contents of which are hereby incorporated by reference, including by way of non-limitation, NEPORs.

The structure of the human EPO protein is predicted to comprise four-helix bundles including helices A, B, C, and D. In various embodiments, the modified EPO protein comprises one or more mutations located in four regions of the EPO protein which are important for bioactivity, i.e., amino acid residues 10-20, 44-51, 96-108, and 142-156. In some embodiments, the one or more mutations are located at residues 11-15, 44-51, 100-108, and 147-151. These residues are localized to helix A (Val11, Arg14, and Tyr15), helix C (Ser100, Arg103, Ser104, and Leu108), helix D (Asn147, Arg150, Gly151, and Leu155), and the NB connecting loop (residues 42-51). In some embodiments, the modified EPO protein comprises mutations in residues between amino acids 41-52 and amino acids 147, 150, 151, and 155. Without wishing to be bound by theory, it is believed that mutations of these residues have substantial effects on both receptor binding and in vitro biological activity. In some embodiments, the modified EPO protein comprises mutations at residues 11, 14, 15, 100, 103, 104, and 108. Without wishing to be bound by theory, it is believed that mutations of these residues have modest effects on receptor binding activity and much greater effects on in vitro biological activity. Illustrative substitutions include, but are not limited to, one or more of Val11Ser, Arg14Ala, Arg14Gln, Tyr15Ile, Pro42Asn, Thr44Ile, Lys45Asp, Val46Ala, Tyr51Phe, Ser100Glu, Ser100Thr, Arg103Ala, Ser104Ile, Ser104Ala, Leu108Lys, Asn147Lys, Arg150Ala, Gly151Ala, and Leu155Ala.

In some embodiments, the modified EPO protein comprises mutations that effect bioactivity and not binding, e.g., those listed in Eliot, et al. Mapping of the Active Site of Recombinant Human Erythropoietin Jan. 15, 1997; *Blood:* 89 (2), the entire contents of which are hereby incorporated by reference.

In some embodiments, the modified EPO protein comprises one or more mutations involving surface residues of the EPO protein that are involved in receptor contact. Without wishing to be bound by theory, it is believed that mutations of these surface residues are less likely to affect protein folding thereby retaining some biological activity. Illustrative surface residues that may be mutated include, but are not limited to, residues 147 and 150. In illustrative embodiments, the mutations are substitutions including, one or more of N147A, N147K, R150A and R150E.

In some embodiments, the modified EPO protein comprises one or more mutations at residues N59, E62, L67, and L70, and one or more mutations that affect disulfide bond formation. Without wishing to be bound by theory, it is believed that these mutations affect folding and/or are predicted be in buried positions and thus affects biological activity indirectly.

In an embodiment, the modified EPO protein comprises a K20E substitution that significantly reduces receptor binding. See Elliott, et al., (1997) *Blood,* 89:493-502, the entire contents of which are hereby incorporated by reference.

Additional EPO mutations that may be incorporated into the chimeric EPO protein of the invention are disclosed in, for example, Elliott, et al., (1997) *Blood,* 89:493-502, the entire contents of which are hereby incorporated by reference and Taylor et al., (2010) *PEDS,* 23(4): 251-260, the entire contents of which are hereby incorporated by reference.

In one embodiment, the present chimeric protein or Fc-based chimeric protein complex has (i) a targeting moiety against FAP and (ii) a targeting moiety which is directed against a tumor cell, along with any of the wildtype or modified or mutant signaling agents described herein. In an embodiment, the present chimeric protein or Fc-based chimeric protein complex has a targeting moiety directed against FAP on dendritic cells and a second targeting moiety directed against PD-L1 or PD-L2 on tumor cells.

In one embodiment, the present chimeric protein or Fc-based chimeric protein complex has (i) a targeting moiety against FAP and (ii) a targeting moiety which is directed against a checkpoint inhibitor marker, along with any of the wildtype or modified or mutant interferons described herein. In an embodiment, the present chimeric protein or Fc-based chimeric protein complex has a targeting moiety directed against FAP on dendritic cells and a second targeting moiety directed against PD-1.

In some embodiments, the signaling agent is a toxin or toxic enzyme. In some embodiments, the toxin or toxic enzyme is derived from plants and bacteria. Illustrative toxins or toxic enzymes include, but are not limited to, the diphtheria toxin, *Pseudomonas* toxin, anthrax toxin, ribosome-inactivating proteins (RIPs) such as ricin and saporin, modeccin, abrin, gelonin, and poke weed antiviral protein. Additional toxins include those disclosed in Mathew et al., (2009) Cancer Sci 100(8): 1359-65, the entire disclosures are hereby incorporated by reference. In such embodiments, the chimeric proteins or Fc-based chimeric protein complex of the present technology may be utilized to induce cell death in cell-type specific manner. In such embodiments, the toxin may be modified, e.g. mutated, to reduce affinity and/or activity of the toxin for an attenuated effect, as described with other signaling agents herein.

Fc Domains

The fragment crystallizable domain (Fc domain) is the tail region of an antibody that interacts with Fc receptors located on the cell surface of cells that are involved in the immune system, e.g., B lymphocytes, dendritic cells, natural killer cells, macrophages, neutrophils, eosinophils, basophils, and mast cells. In IgG, IgA and IgD antibody isotypes, the Fc domain is composed of two identical protein fragments, derived from the second and third constant domains of the antibody's two heavy chains. In IgM and IgE antibody isotypes, the Fc domain contains three heavy chain constant domains (CH domains 2-4) in each polypeptide chain.

In some embodiments, the Fc-based chimeric protein of complex the present technology includes a Fc domain. In some embodiments, the Fc domains are from selected from IgG, IgA, IgD, IgM or IgE. In some embodiments, the Fc domains are from selected from IgG1, IgG2, IgG3, or IgG4.

In some embodiments, the Fc domains are from selected from human IgG, IgA, IgD, IgM or IgE. In some embodiments, the Fc domains are from selected from human IgG1, IgG2, IgG3, or IgG4.

In some embodiments, the Fc domains of the Fc-based chimeric protein complex comprise the CH2 and CH3 regions of IgG. In some embodiments, the IgG is human IgG. In some embodiments, the human IgG is selected from IgG1, IgG2, IgG3, or IgG4.

In some embodiments, the Fc domains comprise one or more mutations. In some embodiments, the mutation(s) to the Fc domains reduces or eliminates the effector function the Fc domains. In some embodiments, the mutated Fc domain has reduced affinity or binding to a target receptor. By way of example, in some embodiments, the mutation to the Fc domains reduces or eliminates the binding of the Fc domains to FcγR. In some embodiments, the FcγR is selected from FcγRI; FcγRIIa, 131 R/R; FcγRIIa, 131 H/H, FcγRIIb; and FcγRIII. In some embodiments, the mutation to the Fc domains reduces or eliminates binding to complement proteins, such as, e.g., C1q. In some embodiments, the mutation to the Fc domains reduces or eliminated binding to both FcγR and complement proteins, such as, e.g., C1q.

In some embodiments, the Fc domains comprise the LALA mutation to reduce or eliminate the effector function of the Fc domains. By way of example, in some embodiments, the LALA mutation comprises L234A and L235A substitutions in human IgG (e.g., IgG1) (wherein the numbering is based on the commonly used numbering of the CH2 residues for human IgG1 according to EU convention (PNAS, Edelman et al., 1969; 63 (1) 78-85)).

In some embodiments, the Fc domains of human IgG comprise a mutation at one or more of L234, L235, K322, D265, P329, and P331 to reduce or eliminate the effector function of the Fc domains. By way of example, in some embodiments, the mutations are selected from L234A, L234F, L235A, L235E, L235Q, K322A, K322Q, D265A, P329G, P329A, P331G, and P331S.

In some embodiments, the Fc domains comprise the FALA mutation to reduce or eliminate the effector function of the Fc domains. By way of example, in some embodiments, the FALA mutation comprises F234A and L235A substitutions in human IgG4.

In some embodiments, the Fc domains of human IgG4 comprise a mutation at one or more of F234, L235, K322, D265, and P329 to reduce or eliminate the effector function of the Fc domains. By way of example, in some embodiments, the mutations are selected from F234A, L235A, L235E, L235Q, K322A, K322Q, D265A, P329G, and P329A.

In some embodiments, the mutation(s) to the Fc domain stabilize a hinge region in the Fc domain. By way of example, in some embodiments, the Fc domain comprises a mutation at S228 of human IgG to stabilize a hinge region. In some embodiments, the mutation is S228P.

In some embodiments, the mutation(s) to the Fc domain promote chain pairing of the Fc domain. In some embodiments, chain pairing is promoted by ionic pairing (a/k/a charged pairs, ionic bond, or charged residue pair).

In some embodiments, the Fc domain comprises a mutation at one more of the following amino acid residues of IgG to promote of ionic pairing: D356, E357, L368, K370, K392, D399, and K409.

By way of example, in some embodiments, the human IgG Fc domain comprise one of the mutation combinations in Table 1 to promote of ionic pairing.

TABLE 1

| Substitution(s) on one Fc Chain | Substitution(s) on other Fc Chain |
| --- | --- |
| D356K D399K | K392D K409D |
| E357R L368R | K370D K409D |
| E357R L368K | K370D K409D |
| E357R D399K | K370D K409D |
| E357R | K370D |
| L368R D399K | K392D K409D |
| L368K D399K | K392D K409D |
| L368R D399K | K409D |
| L368K D399K | K409D |
| L368R | K409D |
| L368K | K409D |
| K370D K409D | E357R D399K |
| K370D K409D | E357R L368R |
| K370D K409D | E357R L368K |
| K370D K409D | E357R D399K |
| K370D K409D | E357R L368R |
| K370D K409D | E357R L368K |
| K370D | E357R |
| K370D | E357R |
| K392D K409D | D356K D399K |
| K392D K409D | L368R D399K |
| K392D K409D | L368K D399K |
| K392D K409D | D399K |
| D399K | K392D K409D |
| D399K | K409D |
| K409D | L368R |
| K409D | L368K |
| K409D | L368R D399K |
| K409D | L368K D399K |
| K409D | L368R |
| K409D | L368K |
| K409D | L368R D399K |
| K409D | L368K D399K |
| K409D | D399K |

In some embodiments, chain pairing is promoted by a knob-in-hole mutations. In some embodiments, the Fc domain comprises one or more mutations to allow for a knob-in-hole interaction in the Fc domain. In some embodiments, a first Fc chain is engineered to express the "knob" and a second Fc chain is engineered to express the complementary "hole." By way of example, in some embodiments, human IgG Fc domain comprises the mutations of Table 2 to allow for a knob-in-hole interaction.

TABLE 2

| Substitution(s) on one Fc Chain | Substitution(s) on other Fc Chain |
| --- | --- |
| T366Y | Y407T |
| T366Y/F405A | T394W/Y407T |
| T366W | Y407A |
| T366W | Y407V |
| T366Y | Y407A |
| T366Y | Y407V |
| T366Y | Y407T |

In some embodiments, the Fc domains in the Fc-based chimeric protein complexes of the present technology comprise any combination of the above-disclosed mutations. By way of example, in some embodiments, the Fc domain comprises mutations that promote ionic pairing and/or a knob-in-hole interaction. By way of example, in some embodiments, the Fc domain comprises mutations that have one or more of the following properties: promote ionic pairing, induce a knob-in-hole interaction, reduce or eliminate the effector function of the Fc domain, and cause Fc stabilization (e.g. at hinge).

By way of example, in some embodiments, a human IgG Fc domains comprise mutations disclosed in Table 3, which promote ionic pairing and/or promote a knob-in-hole interaction in the Fc domain.

TABLE 3

| Substitution(s) on one Fc Chain | Substitution(s) on other Fc Chain |
| --- | --- |
| T366W K370D | E357R Y407A |
| T366W K370D | E357R Y407V |
| T366W K409D | L368R Y407A |
| T366W K409D | L368R Y407V |
| T366W K409D | L368K Y407A |
| T366W K409D | L368K Y407V |
| T366W K409D | L368R D399K Y407A |
| T366W K409D | L368R D399K Y407V |
| T366W K409D | L368K D399K Y407A |
| T366W K409D | L368K D399K Y407V |
| T366W K409D | D399K Y407A |
| T366W K409D | D399K Y407V |
| T366W K392D K409D | D399K Y407A |
| T366W K392D K409D | D399K Y407V |
| T366W K392D K409D | D356K D399K Y407A |
| T366W K392D K409D | D356K D399K Y407V |
| T366W K370D K409D | E357R D399K Y407A |
| T366W K370D K409D | E357R D399K Y407V |
| T366W K370D K409D | E357R L368R Y407A |
| T366W K370D K409D | E357R L368R Y407V |
| T366W K370D K409D | E357R L368K Y407A |
| T366W K370D K409D | E357R L368K Y407V |
| T366W K392D K409D | L368R D399K Y407A |
| T366W K392D K409D | L368R D399K Y407V |
| T366W K392D K409D | L368K D399K Y407A |
| T366W K392D K409D | L368K D399K Y407V |
| E357R T366W | K370D Y407A |
| E357R T366W | K370D Y407V |
| T366W L368R | Y407A K409D |
| T366W L368R | Y407V K409D |
| T366W L368K | Y407A K409D |
| T366W L368K | Y407V K409D |
| T366W L368R D399K | Y407A K409D |
| T366W L368R D399K | Y407V K409D |
| T366W L368K D399K | Y407A K409D |
| T366W L368K D399K | Y407V K409D |
| T366W D399K | Y407A K409D |
| T366W D399K | Y407V K409D |
| 1366W D399K | K392D Y407A K409D |
| T366W D399K | K392D Y407V K409D |
| T366W D356K D399K | K392D Y407A K409D |
| T366W D356K D399K | K392D Y407V K409D |
| E357R T366W D399K | K370D Y407A K409D |
| E357R T366W D399K | K370D Y407V K409D |
| E357R T366W L368R | K370D Y407A K409D |
| E357R T366W L368R | K370D Y407V K409D |
| E357R T366W L368K | K370D Y407A K409D |
| E357R T366W L368K | K370D Y407V K409D |
| T366W L368R D399K | K392D Y407A K409D |
| T366W L368R D399K | K392D Y407V K409D |
| T366W L368K D399K | K392D Y407A K409D |

By way of example, in some embodiments, a human IgG Fc domains comprise mutations disclosed in Table 4, which promote ionic pairing, promote a knob-in-hole interaction, or a combination thereof in the Fc domain. In embodiments, the "Chain 1" and "Chain 2" of Table 4 can be interchanged (e.g. Chain 1 can have Y407T and Chain 2 can have T366Y).

TABLE 4

| Chain 1 mutation | Chain 2 mutation | Reference | IgG |
|---|---|---|---|
| T366Y | Y407T | Ridgway et al., 1996 Protein Engineering, Design and Selection, Volume 9, Issue 7, 1 Jul. 1996, Pages 617-62 | IgG1 |
| T366Y/F405A | T394W/Y407T | Ridgway et al., 1996 Protein Engineering, Design and Selection, Volume 9, Issue 7, 1 Jul. 1996, Pages 617-62 | IgG1 |
| T366W | Y407A | Atwell et al., 1997 JMB Volume 270, Issue 1, 4 Jul. 1997, Pages 26-35 | IgG1 |
| T366W | T366S/L368V/Y407A | Atwell et al., 1997 JMB Volume 270, Issue 1, 4 Jul. 1997, Pages 26-35 | IgG1 |
| T366W | L368A/Y407A | Atwell et al., 1997 JMB Volume 270, Issue 1, 4 Jul. 1997, Pages 26-35 | IgG1 |
| T366W | T366S/L368A/Y407A | Atwell et al., 1997 JMB Volume 270, Issue 1, 4 Jul. 1997, Pages 26-35 | IgG1 |
| T366W | T366S/L368G/Y407V | Atwell et al., 1997 JMB Volume 270, Issue 1, 4 Jul. 1997, Pages 26-35 | IgG1 |
| T366W/D399C | T366S/L368A/K392C/Y407V | Merchant et al., 1998 Nature Biotechnology volume 16, pages 677-681 (1998) | IgG1 |
| T366W/K392C | T366S/L368A/D399C/Y407V | Merchant et al., 1998 Nature Biotechnology volume 16, pages 677-681 (1998) | IgG1 |
| S354C/T366W | Y349C/T366S/L368A/Y407V | Merchant et al., 1998 Nature Biotechnology volume 16, pages 677-681 (1998) | IgG1 |
| Y349C/T366W | S354C/T366S/L368A/Y407V | Merchant et al., 1998 Nature Biotechnology volume 16, pages 677-681 (1998) | IgG1 |
| E356C/T366W | Y349C/T366S/L368A/Y407V | Merchant et al., 1998 Nature Biotechnology volume 16, pages 677-681 (1998) | IgG1 |
| Y349C/T366W | E356C/T366S/L368A/Y407V | Merchant et al., 1998 Nature Biotechnology volume 16, pages 677-681 (1998) | IgG1 |
| E357C/T366W | Y349C/T366S/L368A/Y407V | Merchant et al., 1998 Nature Biotechnology volume 16, pages 677-681 (1998) | IgG1 |
| Y349C/T366W | E357C/T366S/L368A/Y407V | Merchant et al., 1998 Nature Biotechnology volume 16, pages 677-681 (1998) | IgG1 |
| D339R | K409E | Gunasekaran et al., 2010 The Journal of Biological Chemistry 285, 19637-19646. | IgG1 |
| D339K | K409E | Gunasekaran et al., 2010 The Journal of Biological Chemistry 285, 19637-19646. | IgG1 |
| D339R | K409D | Gunasekaran et al., 2010 The Journal of Biological Chemistry 285, 19637-19646. | IgG1 |
| D339K | K409D | Gunasekaran et al., 2010 The Journal of Biological Chemistry 285, 19637-19646. | IgG1 |
| D339K | K360D/K409E | Gunasekaran et al., 2010 The Journal of Biological Chemistry 285, 19637-19646. | IgG1 |
| D339K | K392D/K409E | Gunasekaran et al., 2010 The Journal of Biological Chemistry 285, 19637-19646. | IgG1 |
| D339K/E356K | K392D/K409E | Gunasekaran et al., 2010 The Journal of Biological Chemistry 285, 19637-19646. | IgG1 |
| D339K/E357K | K392D/K409E | Gunasekaran et al., 2010 The Journal of Biological Chemistry 285, 19637-19646. | IgG1 |
| D339K/E356K | K409E/K439D | Gunasekaran et al., 2010 The Journal of Biological Chemistry 285, 19637-19646. | IgG1 |
| D339K/E357K | K370D/K409E | Gunasekaran et al., 2010 The Journal of Biological Chemistry 285, 19637-19646. | IgG1 |
| D339K/E356K/E357K | K370D/K392D/K409E | Gunasekaran et al., 2010 The Journal of Biological Chemistry 285, 19637-19646. | IgG1 |
| S364H/F405A | Y349T/T394F | Moore et al., 2011 mAbs, 3:6, 546-557 | IgG1 |
| S364H/T394F | Y349T/F405A | Moore et al., 2011 mAbs, 3:6, 546-557 | IgG1 |
| D221R/P228R/K409R | D221E/P228E/L368E | Strop et al., 2012 JMB Volume 420, Issue 3, 13 Jul. 2012, Pages 204-219 | IgG1 |
| C223R/E225R/P228R/K409R | C223E/P228E/L368E | Strop et al., 2012 JMB Volume 420, Issue 3, 13 Jul. 2012, Pages 204-219 | IgG2 |
| F405L | K409R | Labrijn et al., 2013 PNAS Mar. 26, 2013. 110 (13) 5145-5150 | IgG1 |
| F405A/Y407V | T394W | Von Kreudenstein et al., 2013 mAbs Volume 5, 2013 - Issue 5, pp.644-654 | IgG1 |
| F405A/Y407V | T366I/T394W | Von Kreudenstein et al., 2013 mAbs Volume 5, 2013 - Issue 5, pp.644-654 | IgG1 |
| F405A/Y407V | T366L/T394W | Von Kreudenstein et al., 2013 mAbs Volume 5, 2013 - Issue 5, pp.644-654 | IgG1 |
| F405A/Y407V | T366L/K392M/T394W | Von Kreudenstein et al., 2013 mAbs Volume 5, 2013 - Issue 5, pp.644-654 | IgG1 |
| L351Y/F405A/Y407V | T366L/K392M/T394W | Von Kreudenstein et al., 2013 mAbs Volume 5, 2013 - Issue 5, pp.644-654 | IgG1 |
| T350V/L351Y/ | T350V/T366L/ | Von Kreudenstein et al., 2013 mAbs | IgG1 |

TABLE 4-continued

| Chain 1 mutation | Chain 2 mutation | Reference | IgG |
|---|---|---|---|
| F405A/Y407V | K392M/T394W | Volume 5, 2013 - Issue 5, pp.644-654 | |
| T350V/L351Y/ | T350V/T366L/ | Von Kreudenstein et al., 2013 mAbs | IgG1 |
| F405A/Y407V | K392L/T394W | Volume 5, 2013 - Issue 5, pp.644-654 | |
| K409W | D339V/F405T | Choi et al., 2013 PNAS Jan. 2, 2013. 110 (1) 270-275 | IgG1 |
| K360E | Q347R | Choi et al., 2013 PNAS Jan. 2, 2013. 110 (1) 270-275 | IgG1 |
| K360E/K409W | D339V/Q347R/F405T | Choi et al., 2013 PNAS Jan. 2, 2013. 110 (1) 270-275 | IgG1 |
| Y349C/K360E/K409W | D339V/Q347R/ S354C/F405T | Choi et al., 2013 PNAS Jan. 2, 2013. 110 (1) 270-275 | IgG1 |
| K392A/K409D | E356K/D399K | Leaver-Fey et al., 2016 Structure Volume 24, Issue 4, 5 Apr. 2016, Pages 641-651 | IgG1 |
| T366W | T366S/L358A/Y407A | Leaver-Fey et al., 2016 Structure Volume 24, Issue 4, 5 Apr. 2016, Pages 641-651 | IgG1 |
| D339M/Y407A | T336V/K409V | Leaver-Fey et al., 2016 Structure Volume 24, Issue 4, 5 Apr. 2016, Pages 641-651 | IgG1 |
| D339M/K360D/Y407A | T336V/E345R/ Q347R/K409V | Leaver-Fey et al., 2016 Structure Volume 24, Issue 4, 5 Apr. 2016, Pages 641-651 | IgG1 |
| Y349S/T366V/ K370Y/K409V | E357D/S364Q/Y407A | Leaver-Fey et al., 2016 Structure Volume 24, Issue 4, 5 Apr. 2016, Pages 641-651 | IgG1 |
| Y349S/T366M/ K370Y/K409V | E356G/E357D/ S364Q/Y407A | Leaver-Fey et al., 2016 Structure Volume 24, Issue 4, 5 Apr. 2016, Pages 641-651 | IgG1 |
| Y349S/T366M/ K370Y/K409V | E357D/S364R/Y407A | Leaver-Fey et al., 2016 Structure Volume 24, Issue 4, 5 Apr. 2016, Pages 641-651 | IgG1 |

And any combination as described in Tables 1-3 of US20150284475A1

By way of example, in some embodiments, a human IgG Fc domain comprises mutations disclosed in Table 5, which reduce or eliminate FcγR and/or complement binding in the Fc domain. In embodiments, the Table 5 mutations are in both chains.

TABLE 5

| Chain 1 mutation | Reference | IgG |
|---|---|---|
| L234A/L235A | Alegre et al., 1994 Transplantation 57:1537-1543 | IgG1 |
| F234A/L235A | Alegre et al., 1994 Transplantation 57:1537-1543 | IgG4 |
| L235E | Morgan et al., 1995 Immunology. 1995 Oct; 86(2): 319-324. | IgG1 |
| L235E | Morgan et al., 1995 Immunology. 1995 Oct; 86(2): 319-324. | IgG4 |
| L235A | Morgan et al., 1995 Immunology. 1995 Oct; 86(2): 319-324. | IgG1 |
| G237A | Morgan et al., 1995 Immunology. 1995 Oct; 86(2): 319-324. | IgG1 |
| N297H | Tao and Morrison, J. Immunol. 1989; 143:2595-2601 | IgG1 |
| N297Q | Tao and Morrison, J. Immunol. 1989; 143:2595-2601 | IgG1 |
| N297K | Tao and Morrison, J. Immunol. 1989; 143:2595-2601 | IgG3 |
| N297Q | Tao and Morrison, J. Immunol. 1989; 143:2595-2601 | IgG3 |
| D265A | Idusogie et al., 2000 J Immunol Apr. 15, 2000, 164 (8) 4178-4184 | IgG1 |
| D270A, V, K | Idusogie et al., 2000 J Immunol Apr. 15, 2000, 164 (8) 4178-4184 | IgG1 |
| K322A, L, M, D, E | Idusogie et al., 2000 J Immunol Apr. 15, 2000, 164 (8) 4178-4184 | IgG1 |

TABLE 5-continued

| Chain 1 mutation | Reference | IgG |
|---|---|---|
| P329A, X | Idusogie et al., 2000 J Immunol Apr. 15, 2000, 164 (8) 4178-4184 | IgG1 |
| P331A, S, G, X | Idusogie et al., 2000 J Immunol Apr. 15, 2000, 164 (8) 4178-4184 | IgG1 |
| D265A | Idusogie et al., 2000 J Immunol Apr. 15, 2000, 164 (8) 4178-4184 | IgG1 |
| L234A | Hezareh et al., 2001 J. Virol. December 2001 vol. 75 no. 24 12161-12168 | IgG1 |
| L234A/L235A | Hezareh et al., 2001 J. Virol. December 2001 vol. 75 no. 24 12161-12168 | IgG1 |
| L234F/L235E/P331S | Oganesyan et al., 2008 Acta Cryst. (2008). D64, 700-704 | IgG1 |
| H268Q/V309L/A330S/P331S | An et al., 2009 mAbs Volume 1, 2009 - Issue 6, pp. 572-579 | IgG1 |
| G236R/L328R | Moore et al., 2011 mAbs Volume 3, 2011 - Issue 6, pp. 546-557 | IgG1 |
| N297G | Couch et al., 2013 Sci. Transl. Med., 5 (2013) 183ra57, 1-12 | IgG1 |
| N297G/D265A | Couch et al., 2013 Sci. Transl. Med., 5 (2013) 183ra57, 1-12 | IgG1 |
| V234A/G237A/P328S/H268A/ V309L/A330S/P331S | Vafa et al., 2014 Methods Volume 65, Issue 1, 1 Jan. 2014, Pages 114-126 | IgG2 |
| L234A/L235A/P329G | Lo et al., 2016 The Journal of Biological Chemistry 292, 3900-3908 | IgG1 |
| N297D | Schlothauer et al., 2016 Protein Engineering, Design and Selection, Volume 29, Issue 10, 1 Oct. 2016, Pages 457-466 | IgG1 |

TABLE 5-continued

| Chain 1 mutation | Reference | IgG |
|---|---|---|
| S228P/L235E | Schlothauer et al., 2016 Protein Engineering, Design and Selection, Volume 29, Issue 10, 1 Oct. 2016, Pages 457-466 | IgG4 |
| S228P/L235E/P329G | Schlothauer et al., 2016 Protein Engineering, Design and Selection, Volume 29, Issue 10, 1 Oct. 2016, Pages 457-466 | IgG4 |
| L234F/L235A/K322Q | Borrok et al., 2017 J Pharm Sci April 2017 Volume 106, Issue 4, Pages 1008-1017 | IgG1 |
| L234F/L235Q/P331G | Borrok et al., 2017 J Pharm Sci April 2017 Volume 106, Issue 4, Pages 1008-1017 | IgG1 |
| L234F/L235Q/K322Q | Borrok et al., 2017 J Pharm Sci April 2017 Volume 106, Issue 4, Pages 1008-1017 | IgG1 |
| L234A/L235A/G237A/P328S/ H268A/A330S/P331S | Tam et al., 2017 Open Access Antibodies 2017, 6(3), 12; doi:10.3390/antib6030012 | IgG1 |
| S228P/F234A/L235A | Tam et al., 2017 Open Access Antibodies 2017, 6(3), 12; doi:10.3390/antib6030012 | IgG4 |
| S228P/F234A/ L235A/G237A/P238S | Tam et al., 2017 Open Access Antibodies 2017, 6(3), 12; doi:10.3390/antib6030012 | IgG4 |
| S228P/F234A/L235A/ G236/G237A/P238S | Tam et al., 2017 Open Access Antibodies 2017, 6(3), 12; doi:10.3390/antib6030012 | IgG4 |

In some embodiments, the Fc domains in the Fc-based chimeric protein complexes of the present technology are homodimeric, i.e., the Fc domain in the chimeric protein complex comprises two identical protein fragments.

In some embodiments, the Fc domains in the Fc-based chimeric protein complexes of the present technology are heterodimeric, i.e., the Fc domain comprises two non-identical protein fragments.

In some embodiments, heterodimeric Fc domains are engineered using ionic pairing and/or knob-in-hole mutations orientation/configuration. In a trans orientation/configuration, the targeting moiety and signaling agent are, in embodiments, not found on the same polypeptide chain in the present Fc-based chimeric protein complexes.

In some embodiments, heterodimeric Fc domains are engineered using ionic pairing and/or knob-in-hole mutations described herein. In some embodiments, the heterodimeric Fc-based chimeric protein complexes have a trans orientation.

In a trans orientation, the targeting moiety and signaling agent are, in embodiments, not found on the same polypeptide chain in the present Fc-based chimeric protein complexes. In a trans orientation, the targeting moiety and signaling agent are, in embodiments, found on separate polypeptide chains in the Fc-based chimeric protein complexes. In a cis orientation, the targeting moiety and signaling agent are, in embodiments, found on the same polypeptide chain in the Fc-based chimeric protein complexes.

In some embodiments, where more than one targeting moiety is present in the heterodimeric protein complexes described herein, one targeting moiety may be in trans orientation (relative to the signaling agent), whereas another targeting moiety may be in cis orientation (relative to the signaling agent). In some embodiments, the signaling agent and target moiety are on the same ends/sides (N-terminal or C-terminal ends) of an Fc domain. In some embodiments, the signaling agent and targeting moiety are on different sides/ends of a Fc domain (N-terminal and C-terminal ends).

In some embodiments, where more than one targeting moiety is present in the heterodimeric protein complexes described herein, the targeting moieties may be found on the same Fc chain or on two different Fc chains in the heterodimeric protein complex (in the latter case the targeting moieties would be in trans relative to each other, as they are on different Fc chains). In some embodiments, where more than one targeting moiety is present on the same Fc chain, the targeting moieties may be on the same or different sides/ends of a Fc chain (N-terminal or/and C-terminal ends).

In some embodiments, where more than one signaling agent is present in the heterodimeric protein complexes described herein, the signaling agents may be found on the same Fc chain or on two different Fc chains in the heterodimeric protein complex (in the latter case the signaling agents would be in trans relative to each other, as they are on different Fc chains). In some embodiments, where more than one signaling agent is present on the same Fc chain, the signaling agents may be on the same or different sides/ends of a Fc chain (N-terminal or/and C-terminal ends).

In some embodiments, where more than one signaling agent is present in the heterodimeric protein complexes described herein, one signaling agent may be in trans orientation (as relates to the targeting moiety), whereas another signaling agent may be in cis orientation (as relates to the targeting moiety).

In some embodiments, the Fc domains includes or starts with the core hinge region of wild-type human IgG1, which contains the sequence Cys-Pro-Pro-Cys. In some embodiments, the Fc domains also include the upper hinge, or parts thereof (e.g., DKTHTCPPC; see WO 2009053368), EPKSCDKTHTCPPC, or EPKSSDKTHTCPPC; see Lo et al., Protein Engineering vol. 11 no. 6 pp. 495-500, 1998)).

Fc-Based Chimeric Protein Complexes

The Fc-based chimeric protein complexes of the present technology comprise at least one Fc domain disclosed herein, at least one signaling agent (SA) disclosed herein, and at least one targeting moiety (TM) disclosed herein.

The present Fc-based chimeric protein complexes may encompass a complex of two fusion proteins, each comprising an Fc domain. In some embodiments, the Fc-based chimeric protein complex is homodimeric.

In some embodiments, the Fc-based chimeric protein complex is heterodimeric. In some embodiments, the heterodimeric Fc-based chimeric protein complex has a trans orientation/configuration. In some embodiments, the heterodimeric Fc-based chimeric protein complex has a cis orientation/configuration. In some embodiments, the heterodimeric Fc-based chimeric protein complex does not comprise the signaling agent and targeting moiety on a single polypeptide.

In some embodiments, the Fc-based chimeric protein has an improved in vivo half-life relative to a chimeric protein lacking an Fc or a chimeric protein that is not a heterodimeric complex. In some embodiments, the Fc-based chimeric protein has an improved solubility, stability and other pharmacological properties relative to a chimeric protein lacking an Fc or a chimeric protein, which is not a heterodimeric complex.

Heterodimeric Fc-based chimeric protein complexes are composed of two different polypeptides. In embodiments described herein, the targeting domain is on a different polypeptide than the signaling agent and accordingly, proteins that contain only one targeting domain copy, and also only one signaling agent copy can be made (this provides a configuration in which potential interference with desired properties can be controlled). Further, in embodiments, one targeting domain (e.g. VHH) only can avoid cross-linking of the antigen on the cell surface (which could elicit undesired effects in some cases) Further, in embodiments, one signaling agent may alleviate molecular "crowding" and potential interference with avidity mediated restoration of effector function in dependence of the targeting domain. Further, in embodiments, heterodimeric Fc-based chimeric protein complexes can have two targeting moieties and these can be placed on the two different polypeptides. For instance, in embodiments, the C-terminus of both targeting moieties (e.g. VHHs) can be masked to avoid potential autoantibodies or pre-existing antibodies (e.g. VHH autoantibodies or pre-existing antibodies). Further, in embodiments, heterodimeric Fc-based chimeric protein complexes, e.g. with the targeting domain on a different polypeptide than the signaling agent (e.g. wild type signaling agent), may favor "cross-linking" of two cell types (e.g. a tumor cell and an immune cell). Further, in embodiments, heterodimeric Fc-based chimeric protein complexes can have two signaling agents, each on different polypeptides to allow more complex effector responses.

Further, in embodiments, heterodimeric Fc-based chimeric protein complexes, e.g. with the targeting domain on a different polypeptide than the signaling agent, combinatorial diversity of targeting moiety and signaling agent is provided in a practical manner. For instance, in embodiments, polypeptides with any of the targeting moieties described herein can be combined "off the shelf" with polypeptides with any of the signaling agents described herein to allow rapid generation of various combinations of targeting moieties and signaling agents in single Fc-based chimeric protein complexes.

In some embodiments, the Fc-based chimeric protein complex comprises one or more linkers. In some embodiments, the Fc-based chimeric protein complex includes a linker that connects the Fc domain, signaling agent(s) and targeting moiety(ies). In some embodiments, the Fc-based chimeric protein complex includes a linker that connects each signaling agent and targeting moiety (or, if more than one targeting moiety, a signaling agent to one of the targeting moieties). In some embodiments, the Fc-based chimeric protein complex includes a linker that connects each signaling agent to the Fc domain. In some embodiments, the Fc-based chimeric protein complex includes a linker that connects each targeting moiety to the Fc domain. In some embodiments, the Fc-based chimeric protein complex includes a linker that connects a targeting moiety to another targeting moiety. In some embodiments, the Fc-based chimeric protein complex includes a linker that connects a signaling agent to another signaling agent.

In some embodiments, a Fc-based chimeric protein complex comprises two or more targeting moieties. In such embodiments, the targeting moieties can be the same targeting moiety or they can be different targeting moieties.

In some embodiments, a Fc-based chimeric protein complex comprises two or more signaling agents. In such embodiments, the signaling agents can be the same targeting moiety or they can be different targeting moieties.

By way of example, in some embodiments, the Fc-based chimeric protein complex comprise a Fc domain, at least two signaling agents (SA), and at least two targeting moieties (TM), wherein the Fc domain, signaling agents, and targeting moieties are selected from any of the Fc domains, signaling agents, and targeting moieties disclosed herein. In some embodiments, the Fc domain is homodimeric.

In various embodiments, the Fc-based chimeric protein complex takes the form of any of the schematics of FIGS. 5A-F. In various embodiments, the Fc-based chimeric protein complex takes the form of any of the schematics of FIGS. 6A-H. In various embodiments, the Fc-based chimeric protein complex takes the form of any of the schematics of FIGS. 7A-H. In various embodiments, the Fc-based chimeric protein complex takes the form of any of the schematics of FIGS. 8A-D. In various embodiments, the Fc-based chimeric protein complex takes the form of any of the schematics of FIGS. 9A-F. In various embodiments, the Fc-based chimeric protein complex takes the form of any of the schematics of FIGS. 10A-J. In various embodiments, the Fc-based chimeric protein complex takes the form of any of the schematics of FIGS. 11A-D. In various embodiments, the Fc-based chimeric protein complex takes the form of any of the schematics of FIGS. 12A-F. In various embodiments, the Fc-based chimeric protein complex takes the form of any of the schematics of FIGS. 13A-J. In various embodiments, the Fc-based chimeric protein complex takes the form of any of the schematics of FIGS. 14A-F. In various embodiments, the Fc-based chimeric protein complex takes the form of any of the schematics of FIGS. 15A-L. In various embodiments, the Fc-based chimeric protein complex takes the form of any of the schematics of FIGS. 16A-L. In various embodiments, the Fc-based chimeric protein complex takes the form of any of the schematics of FIGS. 17A-F. In various embodiments, the Fc-based chimeric protein complex takes the form of any of the schematics of FIGS. 18A-L. In various embodiments, the Fc-based chimeric protein complex takes the form of any of the schematics of FIGS. 19A-L. In various embodiments, the Fc-based chimeric protein complex takes the form of any of the schematics of FIGS. 20A-J. In various embodiments, the Fc-based chimeric protein complex takes the form of any of the schematics of FIGS. 21A-J. In various embodiments, the Fc-based chimeric protein complex takes the form of any of the schematics of FIGS. 22A-F. In various embodiments, the Fc-based chimeric protein complex takes the form of any of the schematics of FIGS. 23A-F.

In some embodiments, the signaling agents are linked to the targeting moieties and the targeting moieties are linked to the Fc domain on the same terminus (see FIGS. 5A-F). In some embodiments, the Fc domain is homodimeric.

In some embodiments, the signaling agents and targeting moieties are linked to the Fc domain, wherein the targeting moieties and signaling agents are linked on the same terminus (see FIGS. 5A-F). In some embodiments, the Fc domain is homodimeric.

In some embodiments, the targeting moieties are linked to signaling agents and the signaling agents are linked to the Fc domain on the same terminus (see FIGS. 5A-F). In some embodiments, the Fc domain is homodimeric.

In some embodiments, the homodimeric Fc-based chimeric protein complex has two or more targeting moieties. In some embodiments, there are four targeting moieties and two signaling agents, the targeting moieties are linked to the Fc domain and the signaling agents are linked to targeting moieties on the same terminus (see FIGS. 6A-H). In some embodiments, the Fc domain is homodimeric. In some embodiments, where there are four targeting moieties and two signaling agents, two targeting moieties are linked to the Fc domain and two targeting moieties are linked to the signaling agents, which are linked to the Fc domain on the same terminus (see FIGS. 6A-H). In some embodiments, the Fc domain is homodimeric. In some embodiments, where there are four targeting moieties and two signaling agents, two targeting moieties are linked to each other and one of the targeting moieties of from each pair is linked to the Fc domain on the same terminus and the signaling agents are linked to the Fc domain on the same terminus (see FIGS. 6A-H). In some embodiments, the Fc domain is homodimeric. In some embodiments, where there are four targeting moieties and two signaling agents, two targeting moieties are linked to each other, wherein one of the targeting moieties of from each pair is linked to a signaling agent and the other targeting moiety of the pair is linked the Fc domain, wherein the targeting moieties linked to the Fc domain are linked on the same terminus (see FIGS. 6A-H). In some embodiments, the Fc domain is homodimeric.

In some embodiments, the homodimeric Fc-based chimeric protein complex has two or more signaling agents. In some embodiments, where there are four signaling agents and two targeting moieties, two signaling agents are linked to each other and one of the signaling agents of from pair is linked to the Fc domain on the same terminus and the targeting moieties are linked to the Fc domain on the same terminus (see FIGS. 7A-H). In some embodiments, the Fc domain is homodimeric. In some embodiments, where there are four signaling agents and two targeting moieties, two signaling agents are linked to the Fc domain one the same terminus and two of the signaling agents are each linked to a targeting moiety, wherein the targeting moieties are linked to the Fc domain at the same terminus (see FIGS. 7A-H). In some embodiments, the Fc domain is homodimeric. In some embodiments, where there are four signaling agents and two targeting moieties, two signaling agents are linked to each other and one of the signaling agents of from pair is linked to a targeting moiety and the targeting moieties are linked to the Fc domain on the same terminus (see FIGS. 7A-H). In some embodiments, the Fc domain is homodimeric.

By way of example, in some embodiments, the Fc-based chimeric protein complex comprise a Fc domain, wherein the Fc domain comprises ionic pairing mutation(s) and/or knob-in-hole mutation(s), at least one signaling agent, and at least one targeting moiety, wherein the ionic pairing motif and/or a knob-in-hole motif, signaling agent, and targeting moiety are selected from any of the ionic pairing motif and/or a knob-in-hole motif, signaling agents, and targeting moieties disclosed herein. In some embodiments, the Fc domain is heterodimeric. In some embodiments, the Fc domain comprises a mutation that reduces or eliminates its effector function.

In some embodiments, the signaling agent is linked to the targeting moiety, which is linked to the Fc domain (see FIGS. 14A-F and 17A-F). In some embodiments, the targeting moiety is linked to the signaling agent, which is linked to the Fc domain (see FIGS. 14A-F and 17A-F). In some embodiments, the Fc domain is heterodimeric. In some embodiments, the Fc domain comprises a mutation that reduces or eliminates its effector function.

In some embodiments, the signaling agent and targeting moiety are linked to the Fc domain (see FIGS. 8A-D, 11A-D, 14A-F, and 17A-F). In some embodiments, the targeting moiety and the signaling agent are linked to different Fc chains on the same terminus (see FIGS. 8A-D and 11A-D). In some embodiments, the targeting moiety and the signaling agent are linked to different Fc chains on different termini (see FIGS. 8A-D and 11A-D). In some embodiments, the targeting moiety and the signaling agent are linked to the same Fc chain (see FIGS. 14A-F and 17A-F). In some embodiments, the Fc domain is heterodimeric. In some embodiments, the Fc domain comprises a mutation that reduces or eliminates its effector function.

In some embodiments, where there are one signaling agent and two targeting moieties, the signaling agent is linked to the Fc domain and two targeting moieties can be: 1) linked to each other with one of the targeting moieties linked to the Fc domain; or 2) each linked to the Fc domain (see FIGS. 9A-F, 12A-F, 15A-L, 18A-L, 20A-J, and 21A-J). In some embodiments, the targeting moieties are linked on one Fc chain and the signaling agent is on the other Fc chain (see FIGS. 9A-F and 12A-F). In some embodiments, the paired targeting moieties and the signaling agent are linked to the same Fc chain (see FIGS. 15A-L and 18A-L).

In some embodiments, a targeting moiety is linked to the Fc domain and the other targeting moiety is linked to the signaling agent, and the paired targeting moiety is linked to the Fc domain (see FIGS. 15A-L, 18A-L, 20A-J, and 21A-J). In some embodiments, the unpaired targeting moiety and paired targeting moiety are linked to the same Fc chain (see FIGS. 15A-L and 18A-L). In some embodiments, the unpaired targeting moiety and paired targeting moiety are linked to different Fc chains (see FIGS. 20A-J and 21A-J). In some embodiments, the unpaired targeting moiety and paired targeting moiety are linked on the same terminus (see FIGS. 20A-J and 21A-J). In some embodiments, the Fc domain is heterodimeric. In some embodiments, the Fc domain comprises a mutation that reduces or eliminates its effector function.

In some embodiments, where there are one signaling agent and two targeting moieties, a targeting moiety is linked to the signaling agent, which is linked to the Fc domain, and the unpaired targeting moiety is linked the Fc domain (see FIGS. 15A-L, 18A-L, 20A-J, and 21A-J). In some embodiments, the paired signaling agent and unpaired targeting moiety are linked to the same Fc chain (see FIGS. 15A-L and 18A-L). In some embodiments, the paired signaling agent and unpaired targeting moiety are linked to different Fc chains (see FIGS. 20A-J and 21A-J). In some embodiments, the paired signaling agent and unpaired targeting moiety are linked on the same terminus (see FIGS. 20A-J and 21A-J). In some embodiments, the Fc domain is heterodimeric. In some embodiments, the Fc domain comprises a mutation that reduces or eliminates its effector function.

In some embodiments, where there are one signaling agent and two targeting moieties, the targeting moieties are linked together and the signaling agent is linked to one of the paired targeting moieties, wherein the targeting moiety not linked to the signaling agent is linked to the Fc domain (see FIGS. 15A-L and 18A-L). In some embodiments, the Fc domain is heterodimeric. In some embodiments, the Fc domain comprises a mutation that reduces or eliminates its effector function.

In some embodiments, where there are one signaling agent and two targeting moieties, the targeting moieties are linked together and the signaling agent is linked to one of the paired targeting moieties, wherein the signaling agent is linked to the Fc domain (see FIGS. 15A-L and 18A-L). In some embodiments, the Fc domain is heterodimeric. In some embodiments, the Fc domain comprises a mutation that reduces or eliminates its effector function.

In some embodiments, where there are one signaling agent and two targeting moieties, the targeting moieties are both linked to the signaling agent, wherein one of the targeting moieties is linked to the Fc domain (see FIGS. 15A-L and 18A-L). In some embodiments, the Fc domain is heterodimeric. In some embodiments, the Fc domain comprises a mutation that reduces or eliminates its effector function.

In some embodiments, where there are one signaling agent and two targeting moieties, the targeting moieties and the signaling agent are linked to the Fc domain (see FIGS. 20A-J and 21A-J). In some embodiments, the targeting moieties are linked on the terminus (see FIGS. 20A-J and 21A-J). In some embodiments, the Fc domain is heterodimeric. In some embodiments, the Fc domain comprises a mutation that reduces or eliminates its effector function.

In some embodiments, where there are two signaling agents and one targeting moiety, the signaling agents are linked to the Fc domain on the same terminus and the targeting moiety is linked to the Fc domain (see FIGS. 10A-J and 13A-J). In some embodiments, the signaling agents are linked to the Fc domain on the same Fc chain and the targeting moiety is linked on the other Fc chain (see FIGS. 22A-F and 23A-F). In some embodiments, the Fc domain is heterodimeric. In some embodiments, the Fc domain comprises a mutation that reduces or eliminates its effector function.

In some embodiments, where there are two signaling agents and one targeting moiety, a signaling agent is linked to the targeting moiety, which is linked to the Fc domain and the other signaling agent is linked to the Fc domain (see FIGS. 10A-J, 13A-J, 16A-L, and 19A-L). In some embodiments, the targeting moiety and the unpaired signaling agent are linked to different Fc chains (see FIGS. 10A-J and 13A-J). In some embodiments, the targeting moiety and the unpaired signaling agent are linked to different Fc chains on the same terminus (see FIGS. 10A-J and 13A-J). In some embodiments, the targeting moiety and the unpaired signaling agent are linked to different Fc chains on different termini (see FIGS. 10A-J and 13A-J). In some embodiments, the targeting moiety and the unpaired signaling agent are linked to the same Fc chains (see FIGS. 16A-L and 19A-L). In some embodiments, the Fc domain is heterodimeric. In some embodiments, the Fc domain comprises a mutation that reduces or eliminates its effector function.

In some embodiments, where there are two signaling agents and one targeting moiety, the targeting moiety is linked to a signaling agent, which is linked to the Fc domain and the other signaling agent is linked to the Fc domain (see FIGS. 10A-J and 13A-J). In some embodiments, the paired signaling agent and the unpaired signaling agent are linked to different Fc chains (see FIGS. 10A-J and 13A-J). In some embodiments, the paired signaling agent and the unpaired signaling agent are linked to different Fc chains on the same terminus (see FIGS. 10A-J and 13A-J). In some embodiments, the paired signaling agent and the unpaired signaling agent are linked to different Fc chains on different termini (see FIGS. 10A-J and 13A-J). In some embodiments, the Fc domain is heterodimeric. In some embodiments, the Fc domain comprises a mutation that reduces or eliminates its effector function.

In some embodiments, where there are two signaling agents and one targeting moiety, the signaling agents are linked together and the targeting moiety is linked to one of the paired signaling agents, wherein the targeting moiety is linked to the Fc domain (see FIGS. 16A-L and 19A-L). In some embodiments, the Fc domain is heterodimeric. In some embodiments, the Fc domain comprises a mutation that reduces or eliminates its effector function.

In some embodiments, where there are two signaling agents and one targeting moiety, the signaling agents are linked together and one of the signaling agents is linked to the Fc domain and the targeting moiety is linked to the Fc domain (see FIGS. 16A-L, 19A-L, 22A-F, and 23A-F). In some embodiments, the paired signaling agents and targeting moiety are linked to the same Fc chain (see FIGS. 16A-L and 19A-L). In some embodiments, the paired signaling agents and targeting moiety are linked to different Fc chains (see FIGS. 22A-F and 23A-F). In some embodiments, the paired signaling agents and targeting moiety are linked to different Fc chains on the same terminus (see FIGS. 22A-F and 23A-F). In some embodiments, the Fc domain is heterodimeric. In some embodiments, the Fc domain comprises a mutation that reduces or eliminates its effector function.

In some embodiments, where there are two signaling agents and one targeting moiety, the signaling agents are both linked to the targeting moiety, wherein one of the signaling agents is linked to the Fc domain (see FIGS. 16A-L and 19A-L). In some embodiments, the Fc domain is heterodimeric. In some embodiments, the Fc domain comprises a mutation that reduces or eliminates its effector function.

In some embodiments, where there are two signaling agents and one targeting moiety, the signaling agents are linked together and one of the signaling agents is linked to the targeting moiety and the other signaling agent is linked to the Fc domain (see FIGS. 16A-L and 19A-L).

In some embodiments, where there are two signaling agents and one targeting moiety, each signaling agent is linked to the Fc domain and the targeting moiety is linked to one of the signaling agents (see FIGS. 16A-L and 19A-L). In some embodiments, the signaling agents are linked to the same Fc chain (see FIGS. 16A-L and 19A-L).

In some embodiments, a targeting moiety or signaling agent is linked to the Fc domain, comprising one or both of $C_H2$ and $C_H3$ domains, and optionally a hinge region. For example, vectors encoding the targeting moiety, signaling agent, or combination thereof, linked as a single nucleotide sequence to an Fc domain can be used to prepare such polypeptides.

Multi-Specific Chimeras and Fusions with Signaling Agents

In some embodiments, the FAP binding agent of the present technology is part of a chimera or fusion or Fc-based chimeric protein complex with one or more signaling agents as described herein and/or one or more additional targeting moieties. Accordingly, the present technology provides for chimeric or fusion proteins or Fc-based chimeric protein complex that include one or more signaling agents and a targeting moiety against FAP and/or one or more additional targeting moieties.

In some embodiments, the FAP binding agent of the present technology is multispecific, i.e., the FAP binding agent comprises two or more targeting moieties having recognition domains that recognize and bind two or more targets, e.g. antigens, or receptors, or epitopes. In such embodiments, the FAP binding agent of the present technology may comprise two more targeting moieties having recognition domains that recognize and bind two or more epitopes on the same antigen or on different antigens. In some embodiments, such multi-specific FAP binding agents exhibit advantageous properties such as increased avidity and/or improved selectivity. In an embodiment, the FAP binding agent of the present technology comprises two targeting moieties and is bispecific, i.e., binds and recognizes two epitopes on the same antigen or on different antigens.

In some embodiments, the multispecific FAP binding agent of the present technology comprises two or more targeting moieties with each targeting moiety being an antibody or an antibody derivative as described herein. In an embodiment, the multispecific FAP binding agent of the present technology comprises at least one VHH comprising an antigen recognition domain against FAP and one antibody or antibody derivative comprising an antigen recognition domain against a tumor antigen.

In some embodiments, the present multispecific FAP binding agents have two or more targeting moieties that target different antigens or receptors, and one targeting moiety may be attenuated for its antigen or receptor, e.g. the targeting moiety binds its antigen or receptor with a low affinity or avidity (including, for example, at an affinity or avidity that is less than the affinity or avidity the other targeting moiety has for its for its antigen or receptor, for instance the difference between the binding affinities may be about 10-fold, or 25-fold, or 50-fold, or 100-fold, or 300-fold, or 500-fold, or 1000-fold, or 5000-fold; for instance the lower affinity or avidity targeting moiety may bind its antigen or receptor at a KD in the mid- to high-nM or low- to mid-pM range while the higher affinity or avidity targeting moiety may bind its antigen or receptor at a KD in the mid- to high-pM or low- to mid-nM range). For instance, in some embodiments, the present multispecific FAP binding agents comprises an attenuated targeting moiety that is directed against a promiscuous antigen or receptor, which may improve targeting to a cell of interest (e.g. via the other targeting moiety) and prevent effects across multiple types of cells, including those not being targeted for therapy (e.g. by binding promiscuous antigen or receptor at a higher affinity than what is provided in these embodiments).

The multispecific FAP binding agent of the present technology may be constructed using methods known in the art, see for example, U.S. Pat. No. 9,067,991, U.S. Patent Publication No. 20110262348 and WO 2004/041862, the entire contents of which are hereby incorporated by reference. In an illustrative embodiment, the multispecific FAP binding agent of the present technology comprising two or more targeting moieties may be constructed by chemical crosslinking, for example, by reacting amino acid residues with an organic derivatizing agent as described by Blattler et al., Biochemistry 24, 1517-1524 and EP294703, the entire contents of which are hereby incorporated by reference. In another illustrative embodiment, the multispecific FAP binding agent comprising two or more targeting moieties is constructed by genetic fusion, i.e., constructing a single polypeptide which includes the polypeptides of the individual targeting moieties. For example, a single polypeptide construct may be formed which encodes a first VHH with an antigen recognition domain against FAP and a second antibody or antibody derivative with an antigen recognition domain against a tumor antigen. A method for producing bivalent or multivalent VHH polypeptide constructs is disclosed in PCT patent application WO 96/34103, the entire contents of which is hereby incorporated by reference. In a further illustrative embodiment, the multispecific FAP binding agent of the present technology may be constructed by using linkers. For example, the carboxy-terminus of a first VHH with an antigen recognition domain against FAP may be linked to the amino-terminus of a second antibody or antibody derivative with an antigen recognition domain against a tumor antigen (or vice versa). Illustrative linkers that may be used are described herein. In some embodiments, the components of the multispecific FAP binding agent of the present technology are directly linked to each other without the use of linkers.

In some embodiments, the multi-specific FAP binding agent of the present technology recognizes and binds to FAP and one or more antigens found on one or more immune cells, which can include, without limitation, megakaryocytes, thrombocytes, erythrocytes, mast cells, basophils, neutrophils, eosinophils, monocytes, macrophages, natural killer cells, T lymphocytes (e.g., cytotoxic T lymphocytes, T helper cells, natural killer T cells), B lymphocytes, plasma cells, dendritic cells, or subsets thereof. In some embodiments, the FAP binding agent specifically binds to an antigen of interest and effectively directly or indirectly recruits one of more immune cells.

In some embodiments, the multi-specific FAP binding agent of the present technology recognizes and binds to FAP and one or more antigens found on tumor cells. In these embodiments, the present FAP binding agents may directly or indirectly recruit an immune cell to a tumor cell or the tumor microenvironment. In some embodiments, the present FAP binding agents may directly or indirectly recruit an immune cell, e.g. an immune cell that can kill and/or suppress a tumor cell (e.g., a CTL), to a site of action (such as, by way of non-limiting example, the tumor microenvironment).

In some embodiments, the present FAP binding agents are capable of, or find use in methods involving, shifting the balance of immune cells in favor of immune attack of a tumor. For instance, the present FAP binding agents can shift the ratio of immune cells at a site of clinical importance in favor of cells that can kill and/or suppress a tumor (e.g. T cells, cytotoxic T lymphocytes, T helper cells, natural killer (NK) cells, natural killer T (NKT) cells, anti-tumor macrophages (e.g. M1 macrophages), neutrophils, B cells, dendritic cells or subsets thereof and in opposition to cells that protect tumors (e.g. myeloid-derived suppressor cells (MDSCs), regulatory T cells (Tregs); tumor associated neutrophils (TANs), M2 macrophages, tumor associated macrophages (TAMs), or subsets thereof). In some embodiments, the present FAP binding agent is capable of increasing a ratio of effector T cells to regulatory T cells.

In some embodiments, the multi-specific FAP binding agent of the present technology comprises a targeting moiety having an antigen recognition domain that specifically binds to an antigen associated with tumor cells. In some embodiments, the targeting moiety directly or indirectly recruits tumor cells. For instance, in some embodiments, the recruitment of the tumor cell is to one or more effector cell (e.g. an immune cell as described herein) that can kill and/or suppress the tumor cell. In some embodiments, the targeting moiety directly or indirectly recruits T cells to a tumor cell, for example, by virtue of the two targeting moieties interacting with their respective antigens on a tumor and FAP-positive immune cell (e.g. dendritic cells).

Tumor cells, or cancer cells refer to an uncontrolled growth of cells or tissues and/or an abnormal increased in cell survival and/or inhibition of apoptosis which interferes with the normal functioning of bodily organs and systems. For example, tumor cells include benign and malignant cancers, polyps, hyperplasia, as well as dormant tumors or micrometastases. Illustrative tumor cells include, but are not limited to cells of: basal cell carcinoma, biliary tract cancer; bladder cancer; bone cancer; brain and central nervous system cancer; breast cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma; hepatic carcinoma; hepatoma; intra-epithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); melanoma; myeloma; neuroblastoma; oral cavity cancer (lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; lymphoma including Hodgkin's and non-Hodgkin's lymphoma, as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia; chronic lymphocytic leukemia (CLL); acute lymphoblastic leukemia (ALL); Hairy cell leukemia; chronic myeloblastic leukemia; as well as other carcinomas and sarcomas; and post-transplant lymphoproliferative disorder (PTLD), as well as abnormal vascular proliferation associated with phakomatoses, edema (e.g. that associated with brain tumors), and Meigs' syndrome.

Tumor cells, or cancer cells also include, but are not limited to, carcinomas, e.g. various subtypes, including, for example, adenocarcinoma, basal cell carcinoma, squamous cell carcinoma, and transitional cell carcinoma), sarcomas (including, for example, bone and soft tissue), leukemia (including, for example, acute myeloid, acute lymphoblastic, chronic myeloid, chronic lymphocytic, and hairy cell), lymphomas and myelomas (including, for example, Hodgkin and non-Hodgkin lymphomas, light chain, non-secretory, MGUS, and plasmacytomas), and central nervous system cancers (including, for example, brain (e.g. gliomas (e.g. astrocytoma, oligodendroglioma, and ependymoma), meningioma, pituitary adenoma, and neuromas, and spinal cord tumors (e.g. meningiomas and neurofibroma).

Illustrative tumor antigens include, but are not limited to, MART-1/Melan-A, gp100, Dipeptidyl peptidase IV (DP-PIV), adenosine deaminase-binding protein (ADAbp), cyclophilin b, Colorectal associated antigen (CRC)-0017-1A/GA733, Carcinoembryonic Antigen (CEA) and its immunogenic epitopes CAP-1 and CAP-2, etv6, am11, Prostate Specific Antigen (PSA) and its immunogenic epitopes PSA-1, PSA-2, and PSA-3, prostate-specific membrane antigen (PSMA), T-cell receptor/CD3-zeta chain, MAGE-family of tumor antigens (e.g., MAGE-A1, MAGE-A2, MAGE-A3, MAGE-A4, MAGE-A5, MAGE-A6, MAGE-A7, MAGE-A8, MAGE-A9, MAGE-A10, MAGE-A11, MAGE-Al2, MAGE-Xp2 (MAGE-B2), MAGE-Xp3 (MAGE-B3), MAGE-Xp4 (MAGE-B4), MAGE-C1, MAGE-C2, MAGE-C3, MAGE-C4, MAGE-05), GAGE-family of tumor antigens (e.g., GAGE-1, GAGE-2, GAGE-3, GAGE-4, GAGE-5, GAGE-6, GAGE-7, GAGE-8, GAGE-9), BAGE, RAGE, LAGE-1, NAG, GnT-V, MUM-1, CDK4, tyrosinase, p53, MUC family, HER2/neu, p21ras, RCAS1, a-fetoprotein, E-cadherin, a-catenin, 3-catenin and y-catenin, p120ctn, gp100 Pme1117, PRAME, NY-ESO-1, cdc27, adenomatous polyposis coli protein (APC), fodrin, Connexin 37, Ig-idiotype, p15, gp75, GM2 and GD2 gangliosides, viral products such as human papilloma virus proteins, Smad family of tumor antigens, Imp-1, NA, EBV-encoded nuclear antigen (EBNA)-1, brain glycogen phosphorylase, SSX-1, SSX-2 (HOM-MEL-40), SSX-1, SSX-4, SSX-5, SCP-1 CT-7, c-erbB-2, CD19, CD20, CD22, CD30, CD33, CD37, CD56, CD70, CD74, CD138, AGS16, MUC1, GPNMB, Ep-CAM, PD-L1, PD-L2, PMSA, and BCMA (TNFRSF17). In some embodiments, the FAP binding agent comprises a targeting moiety that binds one or more of these tumor antigens.

In some embodiments, the present multi-specific FAP binding agent recognizes and binds to FAP as well as an antigen on a tumor cell. In some embodiments, the multi-specific FAP binding agent directly or indirectly recruits CTLs to the tumor cell or tumor microenvironment.

In some embodiments, the present multi-specific FAP binding agent has targeting moieties which target two different cells (e.g. to make a synapse) or the same cell (e.g. to get a more concentrated signaling agent effect).

In some embodiments, the multi-specific FAP binding agent of the present technology comprises a targeting moiety having an antigen recognition domain that specifically binds to a target (e.g. antigen, receptor) associated with T cells. In some embodiments, the targeting moiety recruits directly or indirectly T cells. In an embodiment, the antigen recognition domains specifically bind to effector T cells. In some embodiments, the antigen recognition domain directly or indirectly recruits effector T cells, e.g., in some embodiments, to a therapeutic site (e.g. a locus with one or more disease cell or cell to be modulated for a therapeutic effect). Illustrative effector T cells include cytotoxic T cells (e.g. αβ TCR, CD3+, CD8+, CD45R0+); CD4+ effector T cells (e.g. αβ TCR, CD3+, CD4+, CCR7+, CD62Lhi, IL-7R/CD127+); CD8+ effector T cells (e.g. αβ TCR, CD3+, CD8+, CCR7+, CD62Lhi, IL-7R/CD127+); effector memory T cells (e.g. CD62Llow, CD44+, TCR, CD3+, IL-7R/CD127+, IL-15R+, CCR7low); central memory T cells (e.g. CCR7+, CD62L+, CD27+; or CCR7hi, CD44+, CD62Lhi, TCR, CD3+, IL-7R/CD127+, IL-15R+); CD62L+ effector T cells; CD8+ effector memory T cells (TEM) including early effector memory T cells (CD27+CD62L−) and late effector memory T cells (CD27−CD62L−) (TemE and TemL, respectively); CD127(+)CD25(low/−) effector T cells; CD127(−)CD25(−) effector T cells; CD8+ stem cell memory effector cells (TSCM) (e.g. CD44(low)CD62L(high)CD122(high)sca(+)); TH1 effector T-cells (e.g. CXCR3+, CXCR6+ and CCRS+; or αβ TCR, CD3+, CD4+, IL-12R+, IFNγR+, CXCR3+), TH2 effector T cells (e.g. CCR3', CCR4' and CCR8+; or αβ TCR, CD3+, CD4+, IL-4R+, IL-33R+, CCR4+, IL-17RB+, CRTH2+); TH9 effector T cells (e.g. αβ TCR, CD3+, CD4+); TH17 effector T cells (e.g. αβ TCR, CD3+, CD4+, IL-23R+, CCR6+, IL-1R+); CD4+CD45RO+CCR7+ effector T cells, ICOS+ effector T cells; CD4+CD45RO+CCR7(−) effector T cells; and effector T cells secreting IL-2, IL-4 and/or IFN-γ.

Illustrative T cell antigens of interest include, for example (and inclusive of the extracellular domains, where applicable): CD8, CD3, SLAMF4, IL-2Rα, 4-1BBTNFRSF9, IL-2 Rβ, ALCAM, B7-1, IL-4 R, B7-H3, BLAME/SLAMFS, CEACAM1, IL-6 R, CCR3, IL-7 Rα, CCR4, CXCRI/IL-S RA, CCR5, CCR6, IL-10Rα, CCR 7, IL-10 Rβ, CCRS, IL-12 Rβ1, CCR9, IL-12 Rβ2, CD2, IL-13 Rα1, IL-13, CD3, CD4, ILT2/CDS5j, ILT3/CDS5k, ILT4/CDS5d, ILT5/CDS5a, lutegrin a 4/CD49d, CDS, Integrin a E/CD103, CD6, Integrin α M/CD 11 b, CDS, Integrin α X/CD11c, Integrin β 2/CDIS, KIR/CD15S, CD27/TNFRSF7, KIR2DL1, CD2S, KIR2DL3, CD30/TNFRSFS, KIR2DL4/CD15Sd, CD31/PECAM-1, KIR2DS4, CD40 Ligand/TNFSF5, LAG-3, CD43, LAIR1, CD45, LAIR2, CDS3, Leukotriene B4-R1, CDS4/SLAMF5, NCAM-L1, CD94, NKG2A, CD97, NKG2C, CD229/SLAMF3, NKG2D, CD2F-10/SLAMF9, NT-4, CD69, NTB-A/SLAMF6, Common γ Chain/IL-2 Rγ, Osteopontin, CRACC/

US 12,583,941 B2

105                                                                      106

SLAMF7, PD-1, CRTAM, PSGL-1, CTLA-4, RANK/
TNFRSF11A, CX3CR1, CX3CL1, L-Selectin, CXCR3,
SIRP β 1, CXCR4, SLAM, CXCR6, TCCR/WSX-1,
DNAM-1, Thymopoietin, EMMPRIN/CD147, TIM-1,
EphB6, TIM-2, Fas/TNFRSF6, TIM-3, Fas Ligand/
TNFSF6, TIM-4, Fcγ RIII/CD16, TIM-6, TNFR1/
TNFRSF1A, Granulysin, TNF RIII/TNFRSF1B, TRAIL
RI/TNFRSFIOA, ICAM-1/CD54, TRAIL R2/TNFRSF10B,
ICAM-2/CD102, TRAILR3/TNFRSF10C, IFN-γR1,
TRAILR4/TNFRSF10D, IFN-γ R2, TSLP, IL-1 R1 and
TSLP R. In some embodiments, the FAP binding agent
comprises a targeting moiety that binds one or more of these
illustrative T cell antigens.

In some embodiments, the multi-specific FAP binding
agent of the present technology comprises a targeting moiety
against CD8 which is a VHH comprising a single amino acid
chain having four "framework regions" or FRs and three
"complementary determining regions" or CDRs. As used
herein, "framework region" or "FR" refers to a region in the
variable domain which is located between the CDRs. As
used herein, "complementary determining region" or
"CDR" refers to variable regions in VHHs that contains the
amino acid sequences capable of specifically binding to
antigenic targets.

In some embodiments, the multi-specific FAP binding
agent of the present technology comprises a VHH against
CD8 having a variable domain comprising at least one CD8
CDR1, CD8 CDR2, and/or CD8 CDR3 sequences.

In some embodiments, the CD8 CDR1 sequence is
selected from: SEQ ID NO: 192 or SEQ ID NO: 193.

In some embodiments, the CD8 CDR2 sequence is
selected from: SEQ ID NO: 194 or SEQ ID NO: 195.

In some embodiments, the CD8 CDR3 sequence is
selected from: SEQ ID NO: 196 or SEQ ID NO: 197 or SEQ
ID NO: 198.

In some embodiments, the CD8 targeting moiety com-
prises an amino acid sequence selected from the following
sequences: R3HCD27 (SEQ ID NO: 199); or R3HCD129:
(SEQ ID NO: 200); or R2HCD26: (SEQ ID NO: 201).

In some embodiments, the CD8 targeting moiety com-
prises a VHH having a variable domain comprising at least
one CD8 CDR1, CD8 CDR2, and/or CD8 CDR3 sequences
as described below.

In some embodiments, the CD8 CDR1 sequence is
selected from: SEQ ID NO: 202 to SEQ ID NO: 270.

In some embodiments, the CD8 CDR2 sequence is
selected from: SEQ ID NO: 271 to SEQ ID NO: 339.

In some embodiments, the CD8 CDR3 sequence is
selected from: SEQ ID NO: 340 to SEQ ID NO: 408.

In some embodiments, the CD8 targeting moiety com-
prises an amino acid sequence selected from the following
sequences 1CDA 7 (SEQ ID NO: 409); or 1CDA 12 (SEQ
ID NO: 410); or 1CDA 14 (SEQ ID NO: 411); or 1CDA 15
(SEQ ID NO: 412); or 1CDA 17 (SEQ ID NO: 413); or
1CDA 18 (SEQ ID NO: 414); or 1CDA 19 (SEQ ID NO:
415); or 1CDA 24(SEQ ID NO: 416); or 1CDA 26 (SEQ ID
NO: 417); or 1CDA 28 (SEQ ID NO: 418); or 1CDA 37
(SEQ ID NO: 419); or 1CDA 43 (SEQ ID NO: 420); or
1CDA 45 (SEQ ID NO: 421); or 1CDA 47 (SEQ ID NO:
422); or 1CDA 48 (SEQ ID NO: 423); or 1CDA 58 (SEQ ID
NO: 424); or 1CDA 65 (SEQ ID NO: 425); or 1CDA 68
(SEQ ID NO: 426); or 1CDA 73 (SEQ ID NO: 427); or
1CDA 75 (SEQ ID NO: 428); or 1CDA 86 (SEQ ID NO:
429); or 1CDA 87 (SEQ ID NO: 430); or 1CDA 88 (SEQ ID
NO: 431); or 1CDA 89 (SEQ ID NO: 432); or 1CDA 92
(SEQ ID NO: 433); or 1CDA 93 (SEQ ID NO: 434); or
2CDA 1 (SEQ ID NO: 435); or 2CDA 5 (SEQ ID NO: 436);

or 2CDA 22 (SEQ ID NO: 437); or 2CDA 28 (SEQ ID NO:
438); or 2CDA 62 (SEQ ID NO: 439); or 2CDA 68 (SEQ ID
NO: 440); or 2CDA 73 (SEQ ID NO: 441); or 2CDA 74
(SEQ ID NO: 442); or 2CDA 75 (SEQ ID NO: 443); or
2CDA 77 (SEQ ID NO: 444); or 2CDA 81 (SEQ ID NO:
445); or 2CDA 87 (SEQ ID NO: 446); or 2CDA 88 (SEQ ID
NO: 447); or 2CDA 89 (SEQ ID NO: 448); or 2CDA 91
(SEQ ID NO: 449); or 2CDA 92 (SEQ ID NO: 450); or
2CDA 93 (SEQ ID NO: 451); or 2CDA 94 (SEQ ID NO:
452); or 2CDA 95 (SEQ ID NO: 453); or 3CDA 3 (SEQ ID
NO: 454); or 3CDA 8 (SEQ ID NO: 455); or 3CDA 11 (SEQ
ID NO: 456); or 3CDA 18 (SEQ ID NO: 457); or 3CDA 19
(SEQ ID NO: 458); or 3CDA 21 (SEQ ID NO: 459); or
3CDA 24 (SEQ ID NO: 460); or 3CDA 28 (SEQ ID NO:
461); or 3CDA 29 (SEQ ID NO: 462); or 3CDA 31 (SEQ ID
NO: 463); or 3CDA 32 (SEQ ID NO: 464); or 3CDA 33
(SEQ ID NO: 465); or 3CDA 37 (SEQ ID NO: 466); or
3CDA 40 (SEQ ID NO: 467); or 3CDA 41 (SEQ ID NO:
468); or 3CDA 48 (SEQ ID NO: 469); or 3CDA 57 (SEQ ID
NO: 470); or 3CDA 65 (SEQ ID NO: 471); or 3CDA 70
(SEQ ID NO: 472); or 3CDA 73 (SEQ ID NO: 473); or
3CDA 83 (SEQ ID NO: 474); or 3CDA 86 (SEQ ID NO:
475); or 3CDA 88 (SEQ ID NO: 476); or 3CDA 90 (SEQ ID
NO: 477).

In various illustrative embodiments, the CD8 targeting
moiety comprises an amino acid sequence selected from any
one of the above sequences without the terminal histidine
tag sequence (i.e., HHHHHH; SEQ ID NO: 43).

In some embodiments, the CD8 targeting moiety com-
prises an amino acid sequence described in US Patent
Publication No. 2014/0271462, the entire contents of which
are incorporated by reference. In some embodiments, the
CD8 targeting moiety comprises an amino acid sequence
described in Table 0.1, Table 0.2, Table 0.3, and/or FIGS.
1A-121 of US Patent Publication No. 2014/0271462, the
entire contents of which are incorporated by reference. In
some embodiments, the CD8 targeting moiety comprises a
HCDR1 of SEQ ID NO: 478 or 479 and/or a HCDR2 of SEQ
ID NO: 478 or 479 and/or a HCDR3 of SEQ ID NO: 478 or
479 and/or a LCDR1 of SEQ ID NO: 480 and/or a LCDR2
of SEQ ID NO: 480 and/or a LCDR3 of SEQ ID NO: 480.

In some embodiments, the present technology contem-
plates the use of any natural or synthetic analogs, mutants,
variants, alleles, homologs and orthologs (herein collec-
tively referred to as "analogs") of the targeting moiety
directed against CD8 as described herein. In some embodi-
ments, the amino acid sequence of the targeting moiety
directed against CD8 further includes an amino acid analog,
an amino acid derivative, or other non-classical amino acids.

In some embodiments, the multi-specific FAP binding
agent of the present technology comprises a targeting moiety
having an antigen recognition domain that specifically binds
to a target (e.g., antigen, receptor) associated with B cells. In
some embodiments, the targeting moiety directly or indi-
rectly recruits B cells, e.g., to a therapeutic site (e.g. a locus
with one or more disease cell or cell to be modulated for a
therapeutic effect). By way of example, but not by way of
limitation, in some embodiments, the B cell antigens
include, for example, CD10, CD19, CD20, CD21, CD22,
CD23, CD24, CD37, CD38, CD39, CD40, CD70, CD72,
CD73, CD74, CDw75, CDw76, CD77, CD78, CD79a/b,
CD80, CD81, CD82, CD83, CD84, CD85, CD86, CD89,
CD98, CD126, CD127, CDw130, CD138, CDw150, and
B-cell maturation antigen (BCMA). In some embodiments,
the FAP binding agent comprises a targeting moiety that
binds one or more of the above disclosed B cell antigens.

In some embodiments, the multi-specific FAP binding agent of the present technology comprises a targeting moiety having an antigen recognition domain that specifically bind to a target (e.g. antigen, receptor) associated with Natural Killer cells. In some embodiments, the targeting moiety directly or indirectly recruits Natural Killer cells, e.g., to a therapeutic site (e.g. a locus with one or more disease cell or cell to be modulated for a therapeutic effect). By way of example, but not by way of limitation, in some embodiments, the Natural Killer cell antigens include, for example, TIGIT, 2B4/SLAMF4, KIR2DS4, CD155/PVR, KIR3DL1, CD94, LMIR1/CD300A, CD69, LMIR2/CD300c, CRACC/ SLAMF7, LMIR3/CD300LF, Kidalpha, DNAM-1, LMIR5/ CD300LB, Fc-epsilon RII, LMIR6/CD300LE, Fc-y RI/CD64, MICA, Fc-y RIIB/CD32b, MICB, Fc-y RIIC/ CD32c, MULT-1, Fc-y RIIA/CD32a, Nectin-2/CD112, Fc-y RIII/CD16, NKG2A, FcRH1/IRTA5, NKG2C, FcRH2/ IRTA4, NKG2D, FcRH4/IRTA1, NKp30, FcRH5/IRTA2, NKp44, Fc-Receptor-like 3/CD16-2, NKp46/NCR1, NKp80/KLRF1, NTB-A/SLAMF6, Rae-1, Rae-1 a, Rae-1 p, Rae-1 delta, H60, Rae-1 epsilon, ILT2/CD85j, Rae-1 y, ILT3/CD85k, TREM-1, ILT4/CD85d, TREM-2, ILT5/ CD85a, TREM-3, KIR/CD158, TREML1/TLT-1, KIR2DL1, ULBP-1, KIR2DL3, ULBP-2, KIR2DL4/ CD158d and ULBP-3. In some embodiments, the FAP binding agent comprises a targeting moiety that binds one or more of the above disclosed NK cell antigens.

In some embodiments, the targeting moiety recognizes and/or binds FMS-like tyrosine kinase 3 (Flt3) or is a natural ligand for Flt3, such as, FMS-like tyrosine kinase 3 ligand (Flt3L) or a truncated region thereof (e.g., which is able to bind Flt3). In some embodiments, the targeting moiety is an extracellular domain of Flt3L. In some embodiments, the targeting moiety comprising a Flt3L domain, wherein the Flt3L domain is a single chain dimer, optionally where one Flt3L domain is connected to the other Flt3L domain via one or more linkers, wherein the linker is a flexible linker.

In some embodiments, the multi-specific FAP binding agent of the present technology comprises a targeting moiety having an antigen recognition domain that specifically binds to a target (e.g. antigen, receptor) associated with macro-phages/monocytes. In some embodiments, the targeting moiety directly or indirectly recruits macrophages/mono-cytes, e.g., to a therapeutic site (e.g. a locus with one or more disease cell or cell to be modulated for a therapeutic effect). By way of example, but not by way of limitation, in some embodiments, the macrophages/monocyte antigens include, for example, SIRP1a, B7-1/CD80, ILT4/CD85d, B7-H1, ILT5/CD85a, Common 3 Chain, Integrin a 4/CD49d, BLAME/SLAMF8, Integrin a X/CDIIc, CCL6/C10, Integ-rin 3 2/CD18, CD155/PVR, Integrin 3 3/CD61, CD31/ PECAM-1, Latexin, CD36/SR-B3, Leukotriene B4 R1, CD40/TNFRSF5, LIMPIIISR-B2, CD43, LMIR1/CD300A, CD45, LMIR2/CD300c, CD68, LMIR3/CD300LF, CD84/ SLAMF5, LMIR5/CD300LB, CD97, LMIR6/CD300LE, CD163, LRP-1, CD2F-10/SLAMF9, MARCO, CRACC/ SLAMF7, MD-1, ECF-L, MD-2, EMMPRIN/CD147, MGL2, Endoglin/CD105, Osteoactivin/GPNMB, Fc-y RI/CD64, Osteopontin, Fc-y RIIB/CD32b, PD-L2, Fc-y RIIC/CD32c, Siglec-3/CD33, Fc-y RIIA/CD32a, SIGNR1/ CD209, Fc-y RIII/CD16, SLAM, GM-CSF R a, TCCR/ WSX-1, ICAM-2/CD102, TLR3, IFN-γ RI, TLR4, IFN-gamma R2, TREM-I, IL-I RII, TREM-2, ILT2/CD85j, TREM-3, ILT3/CD85k, TREML1/TLT-1, 2B4/SLAMF 4, IL-10 R a, ALCAM, IL-10 Rp, AminopeptidaseN/ANPEP, ILT2/CD85j, Common 3 Chain, ILT3/CD85k, Clq R1/CD93, ILT4/CD85d, CCR1, ILT5/CD85a, CCR2, CD206, Integrin a 4/CD49d, CCR5, Integrin a M/CDII b, CCR8, Integrin a X/CDIIc, CD155/PVR, Integrin 3 2/CD18, CD14, Integrin 13 3/CD61, CD36/SR-B3, LAIR1, CD43, LAIR2, CD45, Leukotriene B4-R1, CD68, LIMPIIISR-B2, CD84/SLAMFS, LMIR1/CD300A, CD97, LMIR2/ CD300c, CD163, LMIR3/CD300LF, Coagulation Factor III/Tissue Factor, LMIR5/CD300LB, CX3CR1, CX3CL1, LMIR6/CD300LE, CXCR4, LRP-1, CXCR6, M-CSF R, DEP-1/CD148, MD-1, DNAM-1, MD-2, EMMPRIN/ CD147, MMR, Endoglin/CD105, NCAM-L1, Fc-y RI/CD64, PSGL-1, Fc-y RIIICD16, RP105, G-CSF R, L-Selectin, GM-CSF R a, Siglec-3/CD33, HVEM/TN-FRSF14, SLAM, ICAM-1/CD54, TCCR/WSX-1, ICAM-2/ CD102, TREM-I, IL-6 R, TREM-2, CXCRI/IL-8 RA, TREM-3 and TREMLITTLT-1. In some embodiments, the FAP binding agent comprises a targeting moiety that binds one or more of the above disclosed macrophage/monocyte antigens.

In some embodiments, the multi-specific FAP binding agent of the present technology comprises a targeting moiety having an antigen recognition domain that specifically binds to a target (e.g. antigen, receptor) associated with dendritic cells. In some embodiments, the targeting moiety directly or indirectly recruits dendritic cells, e.g., to a therapeutic site (e.g. a locus with one or more disease cell or cell to be modulated for a therapeutic effect). By way of example, but not by way of limitation, in some embodiments, the den-dritic cell (DC) antigens include, for example, FAP, XCR1, RANK, CD36/SRB3, LOX-1/SR-EI, CD68, MARCO, CD163, SR-A1/MSR, CD5L, SREC-1, CL-PI/C0LEC12, SREC-I I, LIMPIIISRB2, RP105, TLR4, TLR1, TLR5, TLR2, TLR6, TLR3, TLR9, 4-IBB Ligand/TNFSF9, IL-12/ 1L-23 p40, 4-Amino-1,8-naphthalimide, ILT2/CD85j, CCL21/6Ckine, ILT3/CD85k, 8-oxo-dG, ILT4/CD85d, 8D6A, ILT5/CD85a, A2B5, lutegrin a 4/CD49d, Aag, Inte-grin p 2/CD18, AMICA, Langerin, B7-2/CD86, Leukotriene B4 RI, B7-H3, LMIR1/CD300A, BLAME/SLAMF8, LMIR2/CD300c, Clq R1/CD93, LMIR3/CD300LF, CCR6, LMIR5/CD300LB CCR7, LMIR6/CD300LE, CD40/TN-FRSF5, MAG/Siglec-4-a, CD43, MCAM, CD45, MD-1, CD68, MD-2, CD83, MDL-1/CLEC5A, CD84/SLAMF5, MMR, CD97, NCAMLI, CD2F-10/SLAMF9, Osteoactivin GPNMB, Chern 23, PD-L2, CLEC-1, RP105, CLEC-2, CLEC-8, Siglec-2/CD22, CRACC/SLAMF7, Siglec-3/ CD33, DC-SIGN, DEC-205, Siglec-5, DC-SIGNR/CD299, Siglec-6, DCAR, Siglec-7, DCIR/CLEC4A, Siglec-9, DEC-205, Siglec-10, Dectin-1/CLEC7A, Siglec-F, Dectin-2/ CLEC6A, SIGNR1/CD209, DEP-1/CD148, SIGNR4, DLEC, SLAM, EMMPRIN/CD147, TCCR/WSX-1, Fc-y RI/CD64, TLR3, Fc-y RIIB/CD32b, TREM-1, Fc-y RIIC/ CD32c, TREM-2, Fc-y RIIA/CD32a, TREM-3, Fc-y RIII/ CD16, TREML1/TLT-1, ICAM-2/CD102, DEC205, and Vanilloid R1. In some embodiments, the FAP binding agent comprises a targeting moiety that binds one or more of the above-disclosed DC antigens.

In some embodiments, the present chimeric protein or Fc-based chimeric protein complex comprises a targeting moiety comprising an amino acid sequence that is at least 60% identical to any one of the sequences disclosed herein. For example, in some embodiments, the chimeric protein or Fc-based chimeric protein complex comprises a targeting moiety comprising an amino acid sequence that is at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% identical to any one of the sequences discloses herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, about 99% or about 100% sequence identity to any one of the sequences disclosed herein).

In some embodiments, the multi-specific FAP binding agent of the present technology comprises a targeting moiety having an antigen recognition domain that specifically binds a target (e.g. antigen, receptor) on immune cells selected from, but not limited to, megakaryocytes, thrombocytes, erythrocytes, mast cells, basophils, neutrophils, and eosinophils. In some embodiments, the antigen recognition domains directly or indirectly recruit megakaryocytes, thrombocytes, erythrocytes, mast cells, basophils, neutrophils, and eosinophil, e.g., to a therapeutic site (e.g. a locus with one or more disease cell or cell to be modulated for a therapeutic effect).

In some embodiments, the multi-specific FAP binding agent of the present technology comprises a targeting moiety having an antigen recognition domain that specifically binds to a target (e.g. antigen, receptor) associated with megakaryocytes and/or thrombocytes. By way of example, but not by way of limitation, in some embodiments, the mega-karyocyte and/or thrombocyte antigens include, for example, GP 11b/111a, GP1b, vWF, PF4, and TSP. In some embodiments, the FAP binding agent comprises a targeting moiety that binds one or more of the above-disclosed megakaryocyte and/or thrombocyte antigens.

In some embodiments, the multi-specific FAP binding agent of the present technology comprises a targeting moiety having an antigen recognition domain that specifically binds to a target (e.g. antigen, receptor) associated with erythrocytes. By way of example, but not by way of limitation, in some embodiments, the erythrocyte antigens include, for example, CD34, CD36, CD38, CD41a (platelet glycoprotein 11b/111a), CD41b (GPIIb), CD71 (transferrin receptor), CD105, glycophorin A, glycophorin C, c-kit, HLA-DR, H2 (MHC-11), and Rhesus antigens. In some embodiments, the FAP binding agent comprises a targeting moiety that binds one or more of the above disclosed erythrocyte antigens.

In some embodiments, the multi-specific FAP binding agent of the present technology comprises a targeting moiety having an antigen recognition domain that specifically binds to a target (e.g. antigen, receptor) associated with mast cells. By way of example, but not by way of limitation, in some embodiments, the mast cells antigens include, for example, SCFR/CD117, Fca, CD2, CD25, CD35, CD88, CD203c, C5R1, CMAI, FCERIA, FCER2, TPSABI. In some embodiments, the FAP binding agent comprises a targeting moiety that binds one or more of the above disclosed mast cell antigens.

In some embodiments, the multi-specific FAP binding agent of the present technology comprises a targeting moiety having an antigen recognition domain that specifically binds to a target (e.g. antigen, receptor) associated with basophils. By way of example, but not by way of limitation, in some embodiments, the basophils antigens include, for example, Fca, CD203c, CD123, CD13, CD107a, CD107b, and CD164. In some embodiments, the FAP binding agent comprises a targeting moiety that binds one or more of the above disclosed basophil antigens.

In some embodiments, the multi-specific FAP binding agent of the present technology comprises a targeting moiety having an antigen recognition domain that specifically binds to a target (e.g. antigen, receptor) associated with neutrophils. By way of example, but not by way of limitation, in some embodiments, the neutrophils antigens include, for example, 7D5, CD10/CALLA, CD13, CD16 (FcRIII), CD18 proteins (LFA-1, CR3, and p150, 95), CD45, CD67, and CD177. In some embodiments, the FAP binding agent comprises a targeting moiety that binds one or more of the above-disclosed neutrophil antigens.

In some embodiments, the multi-specific FAP binding agent of the present technology comprises a targeting moiety having an antigen recognition domain that specifically binds to a target (e.g. antigen, receptor) associated with eosinophils. By way of example, but not by way of limitation, in some embodiments, the eosinophils antigens include, for example, CD35, CD44 and CD69. In some embodiments, the FAP binding agent comprises a targeting moiety that binds one or more of the above-disclosed eosinophil antigens.

In some embodiments, the multi-specific FAP binding agent of the present technology comprises a targeting moiety having an antigen recognition domain that specifically binds to any appropriate antigen or receptor or cell surface markers known by the skilled artisan. In some embodiments, the antigen or cell surface marker is a tissue-specific marker. By way of example, but not by way of limitation, in some embodiments, the tissue-specific markers include, but are not limited to, endothelial cell surface markers (such as, e.g., ACE, CD14, CD34, CDH5, ENG, ICAM2, MCAM, NOS3, PECAMI, PROCR, SELF, SELP, TEK, THBD, VCAMI, VWF); smooth muscle cell surface markers (such as, e.g., ACTA2, MYHIO, MYHI 1, MYH9, MYOCD); fibroblast (stromal) cell surface markers (such as, e.g., ALCAM, CD34, COLIAI, COL1A2, COL3A1, FAP, PH-4); epithelial cell surface markers (such as, e.g., CDID, K61RS2, KRTIO, KRT13, KRT17, KRT18, KRT19, KRT4, KRT5, KRT8, MUCI, TACSTDI); neovasculature markers (such as, e.g., CD13, TFNA, Alpha-v beta-3 (av33), E-selectin); and adipocyte surface markers (such as, e.g., ADIPOQ, FABP4, and RETN). In some embodiments, the FAP binding agent comprises a targeting moiety that binds one or more of the above disclosed antigens.

In some embodiments, the multi-specific FAP binding agent of the present technology comprises a targeting moiety having an antigen recognition domain that specifically binds to a checkpoint marker expressed on a T cell. In some embodiments, the checkpoint marker is one or more checkpoint marker selected from PD-1, CD28, CTLA4, ICOS, BTLA, KIR, LAG3, CD137, OX40, CD27, CD40L, TIM3, and A2aR.

In some embodiments, the multi-specific FAP binding agent of the present technology comprises a targeting moiety having an antigen recognition domain that specifically binds to a checkpoint marker. In some embodiments, the checkpoint marker is one or more checkpoint marker selected from PD-1/PD-L1 or PD-L2, CD28/CD80 or CD86, CTLA4/ CD80 or CD86, ICOS/ICOSL or B7RP1, BTLA/ HVEM, KIR, LAG3, CD137/CD137L, OX40/OX40L, CD27, CD40L, TIM3/Ga19, and A2aR.

By way of example, but not by way of limitation, in some embodiments, the present multispecific FAP binding agent comprises a targeting moiety directed against (i) CD8; (ii) a checkpoint marker expressed on a T cell, e.g. one or more of PD-1, CD28, CTLA4, ICOS, BTLA, KIR, LAG3, CD137, OX40, Cd27, CD40L, TIM3, and A2aR and/or (iii) a targeting moiety is directed against a tumor cell, along with any of the modified (e.g. mutant) signaling agents described herein.

In some embodiments, the present multi-specific FAP binding agent has one or more targeting moieties directed against PD-1. In some embodiments, the FAP binding agent has one or more targeting moieties that selectively bind a PD-1 polypeptide. In some embodiments, the FAP binding agent comprises one or more antibodies, antibody derivatives or formats, peptides or polypeptides, or fusion proteins that selectively bind a PD-1 polypeptide.

In some embodiments, the multi-specific FAP binding agent of the present technology comprises a VHH against PD-1 having a variable domain comprising at least one PD-1 CDR1, PD-1 CDR2, and/or PD-1 CDR3 sequences.

In some embodiments, the PD-1 CDR1 sequence is selected from SEQ ID NO: 481 to SEQ ID NO: 494.

In some embodiments, the PD-1 CDR2 sequence is selected from: SEQ ID NO: 495 to SEQ ID NO: 508.

In some embodiments, the PD-1 CDR3 sequence is selected from: SEQ ID NO: 509 to SEQ ID NO: 521.

In various illustrative embodiments, the PD-1 targeting moiety comprises an amino acid sequence selected from the following sequences: 2PD23: (SEQ ID NO: 522); or 2PD26: (SEQ ID NO: 523); or 2PD90: (SEQ ID NO: 524); or 2PD-106: (SEQ ID NO: 525); or 2PD-16: (SEQ ID NO: 526); or 2PD71: (SEQ ID NO: 527); or 2PD-152: (SEQ ID NO: 528); or 2PD-12: (SEQ ID NO: 529); or 3PD55: (SEQ ID NO: 530); or 3PD82: (SEQ ID NO: 531); or 2PD8: (SEQ ID NO: 532); or 2PD27: (SEQ ID NO: 533); or 2PD82: (SEQ ID NO: 534); or

3PD36: (SEQ ID NO: 535).

In various illustrative embodiments, the PD-1 targeting moiety comprises an amino acid sequence selected from any one of the above without the terminal histidine tag sequence (i.e., without HHHHHH, SEQ ID NO: 43).

In some embodiments, the targeting moiety comprises the anti-PD-1 antibody pembrolizumab (a/k/a MK-3475, KEYTRUDA®), or fragments thereof. In some embodiments, the targeting moiety is one or more of pembrolizumab and other humanized anti-PD-1 antibodies disclosed in Hamid, et al. (2013) New England Journal of Medicine 369 (2): 134-44, U.S. Pat. No. 8,354,509, and WO 2009/114335, the entire disclosures of which are hereby incorporated by reference. By way of example, but not by way of limitation, in some embodiments, the pembrolizumab or an antigen-binding fragment thereof for use in the methods provided herein comprises a heavy chain comprising the amino acid sequence of: (SEQ ID NO: 536); and/or a light chain comprising the amino acid sequence of: (SEQ ID NO: 537).

In some embodiments, the targeting moiety comprises the anti-PD-1 antibody, nivolumab (a/k/a BMS-936558, MDX-1106, ONO-4538, OPDIVO®), or fragments thereof. In some embodiments, the targeting moiety is one or more of the nivolumab (clone 5C4) and other human monoclonal antibodies that specifically bind to PD-1 disclosed in U.S. Pat. No. 8,008,449 and WO 2006/121168, the entire disclosures of which are hereby incorporated by reference. By way of example, but not by way of limitation, in some embodiments, the nivolumab or an antigen-binding fragment thereof for use in the methods provided herein comprises a heavy chain comprising the amino acid sequence of: (SEQ ID NO: 538); and/or a light chain comprising the amino acid sequence of: (SEQ ID NO: 539).

In some embodiments, the targeting moiety comprises the anti-PD-1 antibody pidilizumab (a/k/a CT-011, hBAT or hBAT-1), or fragments thereof. In some embodiments, the pidilizumab and other humanized anti-PD-I monoclonal antibodies are selected from pidilizumab and other humanized anti-PD-I monoclonal antibodies disclosed in US 2008/0025980 and WO 2009/101611, the entire disclosures of which are hereby incorporated by reference. By way of example, but not by way of limitation, in some embodiments, the anti-PD-1 antibody or an antigen-binding fragment thereof for use in the methods provided herein comprises one or more light chain variable regions comprising an amino acid sequence selected from the following sequences disclosed in US 2008/0025980: (SEQ ID NO: 540); (SEQ ID NO: 541); (SEQ ID NO: 542); and (SEQ ID NO: 543); and/or a heavy chain comprising an amino acid sequence selected from the following sequences disclosed in US 2008/0025980: (SEQ ID NO: 544); (SEQ ID NO: 545); (SEQ ID NO: 546); (SEQ ID NO: 547); and (SEQ ID NO: 548).

In some embodiments, the targeting moiety comprises a light chain comprising: (SEQ ID NO: 549); and a heavy chain comprising: (SEQ ID NO: 550).

In some embodiments, the targeting moiety comprises AMP-514 (a/k/a MEDI-0680).

In some embodiments, the targeting moiety comprises the PD-L2-Fc fusion protein AMP-224 or fragments thereof, which are disclosed in WO 2010/027827 and WO 2011/066342, the entire disclosures of which are hereby incorporated by reference. In some embodiments, the targeting moiety comprises: (SEQ ID NO: 551) and/or a B7-DC fusion protein comprising: (SEQ ID NO: 552).

In some embodiments, the targeting moiety comprises the peptide AUNP 12 or any other peptides disclosed in US 2011/0318373 or U.S. Pat. No. 8,907,053. By way of example, but not by way of limitation, in some embodiments, the targeting moiety comprises the AUNP 12 sequence of:

SNTSESFK(SNTSESF)FRVTQLAPKAQIKE-NH$_2$

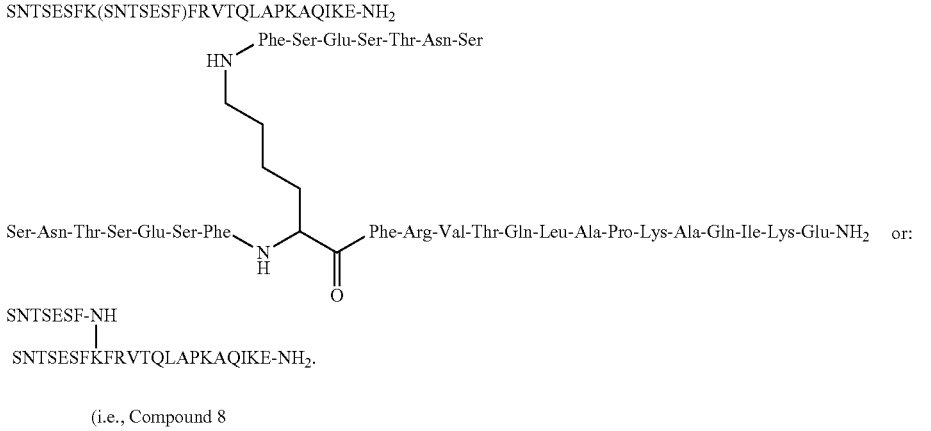

(SEQ ID NO: 553)

SNTSESF-NH
|
SNTSESFKFRVTQLAPKAQIKE-NH$_2$.

(i.e., Compound 8
of
US 2011/0318373)

In some embodiments, the targeting moiety comprises the anti-PD-1 antibody 1E3, or fragments thereof, disclosed in US 2014/0044738, the entire disclosures of which are hereby incorporated by reference. By way of example, but not by way of limitation, in some embodiments, the 1E3 or an antigen-binding fragment thereof for use in the methods provided herein comprises a heavy chain variable region comprising the amino acid sequence of: (SEQ ID NO: 554); and/or a light chain variable region comprising the amino acid sequence of: (SEQ ID NO: 555).

In an embodiment, the targeting moiety comprises the anti-PD-1 antibody 1E8, or fragments thereof, disclosed in US 2014/0044738, the entire disclosures of which are hereby incorporated by reference. By way of example, but not by way of limitation, in some embodiments, the 1E8 or an antigen-binding fragment thereof for use in the methods provided herein comprises a heavy chain variable region comprising the amino acid sequence of: (SEQ ID NO: 556); and/or a light chain variable region comprising the amino acid sequence of: (SEQ ID NO: 557).

In some embodiments, the targeting moiety comprises the anti-PD-1 antibody 1H3, or fragments thereof, disclosed in US 2014/0044738, the entire disclosures of which are hereby incorporated by reference. By way of example, but not by way of limitation, in some embodiments, the 1H3 or an antigen-binding fragment thereof for use in the methods provided herein comprises a heavy chain variable region comprising the amino acid sequence of: (SEQ ID NO: 558); and/or light chain variable region comprising the amino acid sequence of: (SEQ ID NO: 559).

In some embodiments, the targeting moiety comprises a VHH directed against PD-1 disclosed in U.S. Pat. No. 8,907,065 and WO 2008/071447, the entire disclosures of which are hereby incorporated by reference. By way of example, but not by way of limitation, in some embodiments, the VHHs against PD-1 comprise one or more of the following sequences disclosed in U.S. Pat. No. 8,907,065: (SEQ ID NO: 560); (SEQ ID NO: 561); (SEQ ID NO: 562); (SEQ ID NO: 563); or (SEQ ID NO: 564).

In some embodiments, the targeting moiety comprises any one of the anti-PD-1 antibodies, or fragments thereof, disclosed in US 2011/0271358 and WO 2010/036959, the entire contents of which are hereby incorporated by reference. By way of example, but not by way of limitation, in some embodiments, the antibody or an antigen-binding fragment thereof for use in the methods provided herein comprises a heavy chain comprising one or more amino acid sequences selected from the following sequences in US 2011/0271358: (SEQ ID NO: 565); (SEQ ID NO: 566); (SEQ ID NO: 567); (SEQ ID NO: 568); or (SEQ ID NO: 569); and/or a light chain comprising one or more amino acid sequences selected from the following sequences in US 2011/0271358: (SEQ ID NO: 570); (SEQ ID NO: 571); (SEQ ID NO: 572); or (SEQ ID NO: 573).

In some embodiments, the present multi-specific FAP binding agent comprises one or more antibodies directed against PD-1, or antibody fragments thereof, selected from TSR-042 (Tesaro, Inc.), REGN2810 (Regeneron Pharmaceuticals, Inc.), PDR001 (Novartis Pharmaceuticals), and BGB-A317 (BeiGene Ltd.)

In some embodiments, the present multi-specific FAP binding agent has one or more targeting moieties directed against PD-L1. In some embodiments, the FAP binding agent has one or more targeting moieties that selectively bind a PD-L1 polypeptide. In some embodiments, the FAP binding agent comprises one or more antibodies, antibody derivatives or formats, peptides or polypeptides, or fusion proteins that selectively bind a PD-L1 polypeptide.

In some embodiments, the multi-specific FAP binding agent of the present technology comprises a VHH against PD-L1 having a variable domain comprising at least one PD-L1 CDR1, PD-L1 CDR2, and/or PD-L1 CDR3 sequences.

In some embodiments, the PD-L1 CDR1 sequence is selected from: SEQ ID NO: 574 to SEQ ID NO: 604.

In some embodiments, the PD-L1 CDR2 sequence is selected from: SEQ ID NO: 605 to SEQ ID NO: 635.

In some embodiments, the PD-L1 CDR3 sequence is selected from: SEQ ID NO: 636 to SEQ ID NO: 666.

In some embodiments, the PD-L1 targeting moiety comprises an amino acid sequence selected from the following sequences: 2LIG2: (SEQ ID NO: 667); or 2LIG3: (SEQ ID NO: 668); or 2LIG16: (SEQ ID NO: 669); or 2LIG22: (SEQ ID NO: 670); or 2LIG27: (SEQ ID NO: 671); or 2LIG29: (SEQ ID NO: 672); or 2LIG30: (SEQ ID NO: 673); or 2LIG34: (SEQ ID NO: 674); or 2LIG35: (SEQ ID NO: 675); or 2LIG48: (SEQ ID NO: 676); or 2LIG65: (SEQ ID NO: 677); or 2LIG85: (SEQ ID NO: 678); or 2LIG86: (SEQ ID NO: 679); or 2LIG89: (SEQ ID NO: 680); or 2LIG97: (SEQ ID NO: 681); or 2LIG99: (SEQ ID NO: 682); or 2LIG109: (SEQ ID NO: 683); or 2LIG127: (SEQ ID NO: 684); or 2LIG139: (SEQ ID NO: 685); or 2LIG176: (SEQ ID NO: 686); or 2LIG189: (SEQ ID NO: 687); or 3LIG3: (SEQ ID NO: 688); or 3LIG7: (SEQ ID NO: 689); or 3LIG8: (SEQ ID NO: 690); or 3LIG9: (SEQ ID NO: 691); or 3LIG18: (SEQ ID NO: 692); or 3LIG20: (SEQ ID NO: 693); or 3LIG28: (SEQ ID NO: 694); or 3LIG29: (SEQ ID NO: 695); or 3LIG30: (SEQ ID NO: 696); or 3LIG33: (SEQ ID NO: 697).

In some embodiments, the PD-L1 targeting moiety comprises an amino acid sequence selected from any one of the above sequences without the terminal histidine tag sequence (i.e., HHHHHH; SEQ ID NO: 43).

In some embodiment, the targeting moiety comprises the anti-PD-L1 antibody MED14736 (a/k/a durvalumab), or fragments thereof. MED14736 is selective for PD-L1 and blocks the binding of PD-L1 to the PD-1 and CD80 receptors. In some embodiments, the MED14736 and antigen-binding fragments thereof for use in the methods provided herein comprises a heavy chain and a light chain or a heavy chain variable region and a light chain variable region. The sequence of MED14736 is disclosed in WO/2016/06272, the entire contents of which are hereby incorporated by reference. By way of example, but not by way of limitation, in some embodiments, the MED14736 or an antigen-binding fragment thereof for use in the methods provided herein comprises a heavy chain comprising the amino acid sequence of: (SEQ ID NO: 698); and/or a light chain comprising the amino acid sequence of: (SEQ ID NO: 699).

In some embodiments, the MED14736 or an antigen-binding fragment thereof for use in the methods provided herein comprises a heavy chain variable region comprising the amino acid sequence: (SEQ ID NO: 885); and/or a light chain variable region comprising the amino acid sequence: (SEQ ID NO: 886).

In some embodiments, the targeting moiety comprises the anti-PD-L1 antibody atezolizumab (a/k/a MPDL3280A, RG7446), or fragments thereof. By way of example, but not by way of limitation, in some embodiments, the atezolizumab or an antigen-binding fragment thereof for use in the methods provided herein comprises a heavy chain comprising the amino acid sequence of: (SEQ ID NO: 887); and/or a light chain comprising the amino acid sequence of: (SEQ ID NO: 888).

In some embodiments, the targeting moiety comprises the anti-PD-L1 antibody avelumab (a/k/a MSB0010718C), or fragments thereof. By way of example, but not by way of limitation, in some embodiments, the avelumab or an antigen-binding fragment thereof for use in the methods provided herein comprises a heavy chain comprising the amino acid sequence of: (SEQ ID NO: 889); and/or a light chain comprising the amino acid sequence of: (SEQ ID NO: 890).

In some embodiments, the targeting moiety comprises the anti-PD-L1 antibody BMS-936559 (a/k/a 12A4, MDX-1105), or fragments thereof, disclosed in US 2013/0309250 and WO 2007/005874, the entire disclosures of which are hereby incorporated by reference. By way of example, but not by way of limitation, in some embodiments, the BMS-936559 or an antigen-binding fragment thereof for use in the methods provided herein comprises a heavy chain variable region comprising the amino acid sequence of: (SEQ ID NO: 891); and/or a light chain variable region comprising the amino acid sequence of: (SEQ ID NO: 892).

In some embodiments, the targeting moiety comprises the anti-PD-L1 antibody 3G10, or fragments thereof, disclosed in US 2013/0309250 and WO 2007/005874, the entire disclosures of which are hereby incorporated by reference. By way of example, but not by way of limitation, in some embodiments, the 3G10 or an antigen-binding fragment thereof for use in the methods provided herein comprises a heavy chain variable region comprising the amino acid sequence of: (SEQ ID NO: 893); and/or a light chain variable region comprising the amino acid sequence of: (SEQ ID NO: 894).

In some embodiments, the targeting moiety comprises the anti-PD-L1 antibody 10A5, or fragments thereof, disclosed in US 2013/0309250 and WO 2007/005874, the entire disclosures of which are hereby incorporated by reference. By way of example, but not by way of limitation, in some embodiments, the 10A5 or an antigen-binding fragment thereof for use in the methods provided herein comprises a heavy chain variable region comprising the amino acid sequence of: (SEQ ID NO: 895); and/or a light chain variable region comprising the amino acid sequence of: (SEQ ID NO: 896).

In some embodiments, the targeting moiety comprises the anti-PD-L1 antibody 5F8, or fragments thereof, disclosed in US 2013/0309250 and WO 2007/005874, the entire disclosures of which are hereby incorporated by reference. By way of example, but not by way of limitation, in some embodiments, the 5F8 or an antigen-binding fragment thereof for use in the methods provided herein comprises a heavy chain variable region comprising the amino acid sequence of: (SEQ ID NO: 897); and/or a light chain variable region comprising the amino acid sequence of: (SEQ ID NO: 898).

In some embodiments, the targeting moiety comprises the anti-PD-L1 antibody 10H10, or fragments thereof, disclosed in US 2013/0309250 and WO 2007/005874, the entire disclosures of which are hereby incorporated by reference. By way of example, but not by way of limitation, in some embodiments, the 10H10 or an antigen-binding fragment thereof for use in the methods provided herein comprises a heavy chain variable region comprising the amino acid sequence of: (SEQ ID NO: 899); and/or a light chain variable region comprising the amino acid sequence of: (SEQ ID NO: 900).

In some embodiments, the targeting moiety comprises the anti-PD-L1 antibody 1612, or fragments thereof, disclosed in US 2013/0309250 and WO 2007/005874, the entire disclosures of which are hereby incorporated by reference. By way of example, but not by way of limitation, in some embodiments, the 1612 or an antigen-binding fragment thereof for use in the methods provided herein comprises a heavy chain variable region comprising the amino acid sequence of: (SEQ ID NO: 901); and/or a light chain variable region comprising the amino acid sequence of: (SEQ ID NO: 902).

In some embodiments, the targeting moiety comprises the anti-PD-L1 antibody 7H1, or fragments thereof, disclosed in US 2013/0309250 and WO 2007/005874, the entire disclosures of which are hereby incorporated by reference. By way of example, but not by way of limitation, in some embodiments, the 7H1 or an antigen-binding fragment thereof for use in the methods provided herein comprises a heavy chain variable region comprising the amino acid sequence of: (SEQ ID NO: 903); and/or a light chain variable region comprising the amino acid sequence of: (SEQ ID NO: 904).

In some embodiments, the targeting moiety comprises the anti-PD-L1 antibody 11E6, or fragments thereof, disclosed in US 2013/0309250 and WO 2007/005874, the entire disclosures of which are hereby incorporated by reference. By way of example, but not by way of limitation, in some embodiments, the 11E6 or an antigen-binding fragment thereof for use in the methods provided herein comprises a heavy chain variable region comprising the amino acid sequence of: (SEQ ID NO: 905); and/or a light chain variable region comprising the amino acid sequence of: (SEQ ID NO: 906).

In some embodiments, the targeting moiety comprises the anti-PD-L1 antibody 1267, or fragments thereof, disclosed in US 2013/0309250 and WO 2007/005874, the entire disclosures of which are hereby incorporated by reference. By way of example, but not by way of limitation, in some embodiments, the 1267 or an antigen-binding fragment thereof for use in the methods provided herein comprises a heavy chain variable region comprising the amino acid sequence of: (SEQ ID NO: 907); and/or a light chain variable region comprising the amino acid sequence of: (SEQ ID NO: 908).

In some embodiments, the targeting moiety comprises the anti-PD-L1 antibody 13G4, or fragments thereof, disclosed in US 2013/0309250 and WO 2007/005874, the entire disclosures of which are hereby incorporated by reference. By way of example, but not by way of limitation, in some embodiments, the 13G4 or an antigen-binding fragment thereof for use in the methods provided herein comprises a heavy chain variable region comprising the amino acid sequence of: (SEQ ID NO: 909); and/or a light chain variable region comprising the amino acid sequence of: (SEQ ID NO: 910).

In some embodiments, the targeting moiety comprises the anti-PD-L1 antibody 1E12, or fragments thereof, disclosed in US 2014/0044738, the entire disclosures of which are hereby incorporated by reference. By way of example, but not by way of limitation, in some embodiments, the 1E12 or an antigen-binding fragment thereof for use in the methods provided herein comprises a heavy chain variable region comprising the amino acid sequence of: (SEQ ID NO: 911); and/or a light chain variable region comprising the amino acid sequence of: (SEQ ID NO: 912).

In some embodiments, the targeting moiety comprises the anti-PD-L1 antibody 1F4, or fragments thereof, disclosed in US 2014/0044738, the entire disclosures of which are hereby incorporated by reference. By way of example, but not by way of limitation, in some embodiments, the 1F4 or an antigen-binding fragment thereof for use in the methods provided herein comprises a heavy chain variable region comprising the amino acid sequence of: (SEQ ID NO: 913); and/or a light chain variable region comprising the amino acid sequence of: (SEQ ID NO: 914).

In some embodiments, the targeting moiety comprises the anti-PD-L1 antibody 2G11, or fragments thereof, disclosed in US 2014/0044738, the entire disclosures of which are hereby incorporated by reference. By way of example, but not by way of limitation, in some embodiments, the 2G11 or an antigen-binding fragment thereof for use in the methods provided herein comprises a heavy chain variable region comprising the amino acid sequence of: (SEQ ID NO: 700); and/or a light chain variable region comprising the amino acid sequence of: (SEQ ID NO: 701).

In some embodiments, the targeting moiety comprises the anti-PD-L1 antibody 3B6, or fragments thereof, disclosed in US 2014/0044738, the entire disclosures of which are hereby incorporated by reference. By way of example, but not by way of limitation, in some embodiments, the 3B6 or an antigen-binding fragment thereof for use in the methods provided herein comprises a heavy chain variable region comprising the amino acid sequence of: (SEQ ID NO: 702);

and/or a light chain variable region comprising the amino acid sequence of: (SEQ ID NO: 703).

In some embodiments, the targeting moiety comprises the anti-PD-L1 antibody 3D10, or fragments thereof, disclosed in US 2014/0044738 and WO 2012/145493, the entire disclosures of which are hereby incorporated by reference. By way of example, but not by way of limitation, in some embodiments, the 3D10 or an antigen-binding fragment thereof for use in the methods provided herein comprises a heavy chain variable region comprising the amino acid sequence of: (SEQ ID NO: 704); and/or a light chain variable region comprising the amino acid sequence of: (SEQ ID NO: 705).

In some embodiments, the targeting moiety comprises any one of the anti-PD-L1 antibodies disclosed in US2011/0271358 and WO 2010/036959, the entire contents of which are hereby incorporated by reference. By way of example, but not by way of limitation, in some embodiments, the antibody or an antigen-binding fragment thereof for use in the methods provided herein comprises a heavy chain comprising one or more amino acid sequences selected from the following sequences in US2011/0271358: (SEQ ID NO: 706); (SEQ ID NO: 707); (SEQ ID NO: 708); (SEQ ID NO: 709); or (SEQ ID NO: 710); and/or a light chain comprising one or more amino acid sequences selected from the following sequences in US2011/0271358: (SEQ ID NO: 711); (SEQ ID NO: 712); (SEQ ID NO: 713); or (SEQ ID NO: 714).

In some embodiments, the targeting moiety comprises the anti-PD-L1 antibody 2.7A4, or fragments thereof, disclosed in WO 2011/066389, US8,779,108, and US 2014/0356353, the entire disclosures of which are hereby incorporated by reference. By way of example, but not by way of limitation, in some embodiments, the 2.7A4 or an antigen-binding fragment thereof for use in the methods provided herein comprises a heavy chain variable region comprising the amino acid sequence of: (SEQ ID NO: 715); and/or a light chain variable region comprising the amino acid sequence of: (SEQ ID NO: 716).

In some embodiments, the targeting moiety comprises the anti-PD-L1 antibody 2.9D10, or fragments thereof, disclosed in WO 2011/066389, U.S. Pat. No. 8,779,108, and US 2014/0356353, the entire disclosures of which are hereby incorporated by reference. By way of example, but not by way of limitation, in some embodiments, the 2.9D10 or an antigen-binding fragment thereof for use in the methods provided herein comprises a heavy chain variable region comprising the amino acid sequence of: (SEQ ID NO: 717); and/or a light chain variable region comprising the amino acid sequence of: (SEQ ID NO: 718).

In some embodiments, the targeting moiety comprises the anti-PD-L1 antibody 2.14H9, or fragments thereof, disclosed in WO 2011/066389, U.S. Pat. No. 8,779,108, and US 2014/0356353, the entire disclosures of which are hereby incorporated by reference. By way of example, but not by way of limitation, in some embodiments, the 2.14H9 or an antigen-binding fragment thereof for use in the methods provided herein comprises a heavy chain variable region comprising the amino acid sequence of: (SEQ ID NO: 719); and/or a light chain variable region comprising the amino acid sequence of: (SEQ ID NO: 720).

In some embodiments, the targeting moiety comprises the anti-PD-L1 antibody 2.20A8, or fragments thereof, disclosed in WO 2011/066389, U.S. Pat. No. 8,779,108, and US 2014/0356353, the entire disclosures of which are hereby incorporated by reference. By way of example, but not by way of limitation, in some embodiments, the 2.20A8 or an antigen-binding fragment thereof for use in the methods provided herein comprises a heavy chain variable region comprising the amino acid sequence of: (SEQ ID NO: 721); and/or a light chain variable region comprising the amino acid sequence of: (SEQ ID NO: 722).

In some embodiments, the targeting moiety comprises the anti-PD-L1 antibody 3.15G8, or fragments thereof, disclosed in WO 2011/066389, U.S. Pat. No. 8,779,108, and US 2014/0356353, the entire disclosures of which are hereby incorporated by reference. By way of example, but not by way of limitation, in some embodiments, the 3.15G8 or an antigen-binding fragment thereof for use in the methods provided herein comprises a heavy chain variable region comprising the amino acid sequence of: (SEQ ID NO: 723); and/or a light chain variable region comprising the amino acid sequence of: (SEQ ID NO: 724).

In some embodiments, the targeting moiety comprises the anti-PD-L1 antibody 3.18G1, or fragments thereof, disclosed in WO 2011/066389, U.S. Pat. No. 8,779,108, and US 2014/0356353, the entire disclosures of which are hereby incorporated by reference. By way of example, but not by way of limitation, in some embodiments, the 3.18G1 or an antigen-binding fragment thereof for use in the methods provided herein comprises a heavy chain variable region comprising the amino acid sequence of: (SEQ ID NO: 725); and/or a light chain variable region comprising the amino acid sequence of: (SEQ ID NO: 726).

In some embodiments, the targeting moiety comprises the anti-PD-L1 antibody 2.7A4OPT, or fragments thereof, disclosed in WO 2011/066389, U.S. Pat. No. 8,779,108, and US 2014/0356353, the entire disclosures of which are hereby incorporated by reference. By way of example, but not by way of limitation, in some embodiments, the 2.7A4OPT or an antigen-binding fragment thereof for use in the methods provided herein comprises a heavy chain variable region comprising the amino acid sequence of: (SEQ ID NO: 727); and/or a light chain variable region comprising the amino acid sequence of: (SEQ ID NO: 728).

In some embodiments, the targeting moiety comprises the anti-PD-L1 antibody 2.14H90PT, or fragments thereof, as disclosed in WO 2011/066389, U.S. Pat. No. 8,779,108, and US 2014/0356353, the entire disclosures of which are hereby incorporated by reference. By way of example, but not by way of limitation, in some embodiments, the 2.14H90PT or an antigen-binding fragment thereof for use in the methods provided herein comprises a heavy chain variable region comprising the amino acid sequence of: (SEQ ID NO: 729); and/or a light chain variable region comprising the amino acid sequence of: (SEQ ID NO: 730).

In some embodiments, the targeting moiety comprises any one of the anti-PD-L1 antibodies disclosed in WO 2016/061142, the entire contents of which are hereby incorporated by reference. By way of example, but not by way of limitation, in some embodiments, the antibody or an antigen-binding fragment thereof for use in the methods provided herein comprises a heavy chain comprising one or more amino acid sequences selected from the following sequences in WO 2016/061142: (SEQ ID NO: 731); (SEQ ID NO: 732); (SEQ ID NO: 733); (SEQ ID NO: 734); (SEQ ID NO: 735); (SEQ ID NO: 736); (SEQ ID NO: 737); (SEQ ID NO: 738); or (SEQ ID NO: 739); and/or a light chain comprising one or more amino acid sequences selected from the following sequences in WO 2016/061142: (SEQ ID NO: 740); (SEQ ID NO: 741); (SEQ ID NO: 742); (SEQ ID NO: 743); (SEQ ID NO: 744); (SEQ ID NO: 745); (SEQ ID NO: 746); (SEQ ID NO: 747); or (SEQ ID NO: 748).

In some embodiments, the targeting moiety comprises any one of the anti-PD-L1 antibodies disclosed in WO 2016/022630, the entire contents of which are hereby incorporated by reference. By way of example, but not by way of limitation, in some embodiments, the antibody or an antigen-binding fragment thereof for use in the methods provided herein comprises a heavy chain comprising one or more amino acid sequences selected from the following sequences in WO 2016/022630: (SEQ ID NO: 749); (SEQ ID NO: 750); (SEQ ID NO: 751); (SEQ ID NO: 752); (SEQ ID NO: 753); (SEQ ID NO: 754); (SEQ ID NO: 755); (SEQ ID NO: 756); (SEQ ID NO: 757); (SEQ ID NO: 758); (SEQ ID NO: 759); (SEQ ID NO: 760); and/or a light chain comprising one or more amino acid sequences selected from the following sequences in WO 2016/022630: (SEQ ID NO: 761); (SEQ ID NO: 762); (SEQ ID NO: 763); (SEQ ID NO: 764); (SEQ ID NO: 765); (SEQ ID NO: 766); (SEQ ID NO: 767); (SEQ ID NO: 768); (SEQ ID NO: 769); (SEQ ID NO: 770); (SEQ ID NO: 771); and (SEQ ID NO: 772).

In some embodiments, the targeting moiety comprises any one of the anti-PD-L1 antibodies disclosed in WO 2015/112900, the entire contents of which are hereby incorporated by reference. By way of example, but not by way of limitation, in some embodiments, the antibody or an antigen-binding fragment thereof for use in the methods provided herein comprises a heavy chain comprising one or more amino acid sequences selected from the following sequences in WO 2015/112900: (SEQ ID NO: 773); (SEQ ID NO: 774); (SEQ ID NO: 775); or (SEQ ID NO: 776); and/or a light chain comprising one or more amino acid sequences selected from the following sequences in WO 2015/112900: (SEQ ID NO: 777); (SEQ ID NO: 778); (SEQ ID NO: 779); (SEQ ID NO: 780); (SEQ ID NO: 781); (SEQ ID NO: 782); (SEQ ID NO: 783); (SEQ ID NO: 784); or (SEQ ID NO: 785).

In some embodiments, the targeting moiety comprises any one of the anti-PD-L1 antibodies disclosed in WO 2010/077634 and U.S. Pat. No. 8,217,149, the entire disclosures of which are hereby incorporated by reference. By way of example, but not by way of limitation, in some embodiments, the anti-PD-L1 antibody or an antigen-binding fragment thereof for use in the methods provided herein comprises a heavy chain region comprising the amino acid sequence of: (SEQ ID NO: 786); and/or a light chain variable region comprising the amino acid sequence of: (SEQ ID NO: 787).

In some embodiments, the targeting moiety comprises any one of the anti-PD-L1 antibodies obtainable from the hybridoma accessible under CNCM deposit numbers CNCM 1-4122, CNCM 1-4080 and CNCM 1-4081 disclosed in US 20120039906, the entire disclosures of which are hereby incorporated by reference.

In some embodiments, the targeting moiety comprises a VHH directed against PD-L1 disclosed, in U.S. Pat. No. 8,907,065 and WO 2008/071447, the entire disclosures of which are hereby incorporated by reference. By way of example, but not by way of limitation, in some embodiments, the VHHs against PD-L1 comprise one or more of the following sequences in U.S. Pat. No. 8,907,065: (SEQ ID NO: 788); (SEQ ID NO: 789); (SEQ ID NO: 790); (SEQ ID NO: 791); (SEQ ID NO: 792); and (SEQ ID NO: 793).

In some embodiments, the present multi-specific FAP binding agent has one or more targeting moieties directed against PD-L2. In some embodiments, the FAP binding agent has one or more targeting moieties that selectively bind a PD-L2 polypeptide. In some embodiments, the FAP binding agent comprises one or more antibodies, antibody derivatives or formats, peptides or polypeptides, or fusion proteins that selectively bind a PD-L2 polypeptide.

In some embodiments, the targeting moiety comprises a VHH directed against PD-L2 disclosed in U.S. Pat. No. 8,907,065 and WO 2008/071447, the entire disclosures of which are hereby incorporated by reference. By way of example, but not by way of limitation, in some embodiments, the VHHs against PD-1 comprise one or more of the following sequences in U.S. Pat. No. 8,907,065: (SEQ ID NO: 794); (SEQ ID NO: 795); (SEQ ID NO: 796); (SEQ ID NO: 797); (SEQ ID NO: 798); (SEQ ID NO: 799); and (SEQ ID NO: 800).

In some embodiments, the targeting moiety comprises any one of the anti-PD-L2 antibodies disclosed in US2011/0271358 and WO2010/036959, the entire contents of which are hereby incorporated by reference. By way of example, but not by way of limitation, in some embodiments, the antibody or an antigen-binding fragment thereof for use in the methods provided herein comprises a heavy chain comprising one or more amino acid sequences selected from the following sequences in US 2011/0271358: (SEQ ID NO: 801); (SEQ ID NO: 802); (SEQ ID NO: 803); (SEQ ID NO: 804); or (SEQ ID NO: 805); and/or a light chain comprising one or more amino acid sequences selected from the following sequences in US 2011/0271358: (SEQ ID NO: 806); (SEQ ID NO: 807); (SEQ ID NO: 808); or (SEQ ID NO: 809).

In some embodiments, the targeting moieties of the present technology comprises a sequence that targets PD-1, PD-L1, and/or PD-L2 that is at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% identical to any of the sequences disclosed herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, about 99% or about 100% sequence identity with any of the sequences disclosed herein).

In some embodiments, the targeting moieties of the present technology comprise any combination of heavy chain, light chain, heavy chain variable region, light chain variable region, complementarity determining region (CDR), and framework region sequences that target PD-1, PD-L1, and/or PD-L2 as disclosed herein.

In some embodiments, the targeting moiety is one or more antibodies, antibody derivatives or formats, peptides or polypeptides, or fusion proteins that selectively bind or target PD-1, PD-L1 and/or PD-L2 disclosed in WO 2011/066389, US 2008/0025980, US 2013/0034559, U.S. Pat.

No. 8,779,108, US 2014/0356353, U.S. Pat. No. 8,609,089, US 2010/028330, US 2012/0114649, WO 2010/027827, WO 2011/066342, U.S. Pat. No. 8,907,065, WO 2016/062722, WO 2009/101611, WO2010/027827, WO 2011/066342, WO 2007/005874, WO 2001/014556, US2011/0271358, WO 2010/036959, WO 2010/077634, U.S. Pat. No. 8,217,149, US 2012/0039906, WO 2012/145493, US 2011/0318373, U.S. Pat. No. 8,779,108, US 20140044738, WO 2009/089149, WO 2007/00587, WO 2016061142, WO 2016,02263, WO 2010/077634, and WO 2015/112900, the entire disclosures of which are hereby incorporated by reference.

In some embodiments, the multi-specific FAP binding agent of the present technology comprises a targeting moiety having an antigen recognition domain that specifically binds to XCR1, e.g. on dendritic cells. In some embodiments, the multi-specific FAP binding agent of the present technology comprises a targeting moiety having an antigen recognition domain that comprise all of or part of XCL1.

In some embodiments, the multi-specific FAP binding agents have targeting moieties having recognition domains, which specifically bind to a target (e.g. antigen, receptor) that is part of a non-cellular structure. In some embodiments, the antigen or receptor is not an integral component of an intact cell or cellular structure. In some embodiments, the antigen or receptor is an extracellular antigen or receptor. In some embodiments, the target is a non-proteinaceous, non-cellular marker, including, without limitation, nucleic acids, inclusive of DNA or RNA, such as, for example, DNA released from necrotic tumor cells or extracellular deposits such as cholesterol.

In some embodiments, the target (e.g. antigen, receptor) of interest is part of the non-cellular component of the stroma or the extracellular matrix (ECM) or the markers associated therewith. As used herein, stroma refers to the connective and supportive framework of a tissue or organ. Stroma may include a compilation of cells such as fibroblasts/myofibroblasts, glial, epithelia, fat, immune, vascular, smooth muscle, and immune cells along with the extracellular matrix (ECM) and extracellular molecules. In some embodiments, the target (e.g. antigen, receptor) of interest is part of the non-cellular component of the stroma such as the extracellular matrix and extracellular molecules. As used herein, the ECM refers to the non-cellular components present within all tissues and organs. The ECM is composed of a large collection of biochemically distinct components including, without limitation, proteins, glycoproteins, proteoglycans, and polysaccharides. These components of the ECM are usually produced by adjacent cells and secreted into the ECM via exocytosis. Once secreted, the ECM components often aggregate to form a complex network of macromolecules. In some embodiments, the chimeric protein or Fc-based chimeric protein complex of the present technology comprises a targeting moiety that recognizes a target (e.g., an antigen or receptor or non-proteinaceous molecule) located on any component of the ECM. Illustrative components of the ECM include, without limitation, the proteoglycans, the non-proteoglycan polysaccharides, fibers, and other ECM proteins or ECM non-proteins, e.g. polysaccharides and/or lipids, or ECM associated molecules (e.g. proteins or non-proteins, e.g. polysaccharides, nucleic acids and/or lipids).

In some embodiments, the targeting moiety recognizes a target (e.g. antigen, receptor) on ECM proteoglycans. Proteoglycans are glycosylated proteins. The basic proteoglycan unit includes a core protein with one or more covalently attached glycosaminoglycan (GAG) chains. Proteoglycans have a net negative charge that attracts positively charged sodium ions (Na+), which attracts water molecules via osmosis, keeping the ECM and resident cells hydrated. Proteoglycans may also help to trap and store growth factors within the ECM. Illustrative proteoglycans that may be targeted by the chimeric proteins or Fc-based chimeric protein complex of the present technology include, but are not limited to, heparan sulfate, chondroitin sulfate, and keratan sulfate. In an embodiment, the targeting moiety recognizes a target (e.g. antigen, receptor) on non-proteo-glycan polysaccharides such as hyaluronic acid.

In some embodiments, the targeting moiety recognizes a target (e.g. antigen, receptor) on ECM fibers. ECM fibers include collagen fibers and elastin fibers. In some embodiments, the targeting moiety recognizes one or more epitopes on collagens or collagen fibers. Collagens are the most abundant proteins in the ECM. Collagens are present in the ECM as fibrillar proteins and provide structural support to resident cells. In one or more embodiments, the targeting moiety recognizes and binds to various types of collagens present within the ECM including, without limitation, fibrillar collagens (types I, II, III, V, XI), facit collagens (types IX, XII, XIV), short chain collagens (types VIII, X), basement membrane collagens (type IV), and/or collagen types VI, VII, or XIII. Elastin fibers provide elasticity to tissues, allowing them to stretch when needed and then return to their original state. In some embodiments, the target moiety recognizes one or more epitopes on elastins or elastin fibers.

In some embodiments, the targeting moiety recognizes one or more ECM proteins including, but not limited to, a tenascin, a fibronectin, a fibrin, a laminin, or a nidogen/entactin.

In some embodiments, the targeting moiety recognizes and binds to tenascin. The tenascin (TN) family of glycoproteins includes at least four members, tenascin-C, tenascin-R, tenascin-X, and tenascin W. The primary structures of tenascin proteins include several common motifs ordered in the same consecutive sequence: amino-terminal heptad repeats, epidermal growth factor (EGF)-like repeats, fibronectin type III domain repeats, and a carboxyl-terminal fibrinogen-like globular domain. Each protein member is associated with typical variations in the number and nature of EGF-like and fibronectin type III repeats. Isoform variants also exist particularly with respect to tenascin-C. Over 27 splice variants and/or isoforms of tenascin-C are known. In a particular embodiment, the targeting moiety recognizes and binds to tenascin-CA1. Similarly, tenascin-R also has various splice variants and isoforms. Tenascin-R usually exists as dimers or trimers. Tenascin-X is the largest member of the tenascin family and is known to exist as trimers. Tenascin-W exists as trimers. In some embodiments, the targeting moiety recognizes one or more epitopes on a tenascin protein. In some embodiments, the targeting moiety recognizes the monomeric and/or the dimeric and/or the trimeric and/or the hexameric forms of a tenascin protein.

In an embodiment, the targeting moieties recognize and bind to fibronectin. Fibronectins are glycoproteins that connect cells with collagen fibers in the ECM, allowing cells to move through the ECM. Upon binding to integrins, fibronectins unfold to form functional dimers. In some embodiments, the targeting moiety recognizes the mono-meric and/or the dimeric forms of fibronectin. In some embodiments, the targeting moiety recognizes one or more epitopes on fibronectin. By way of example, but not by way of limitation, in some embodiments, the targeting moiety recognizes fibronectin extracellular domain A (EDA) or fibronectin extracellular domain B (EDB). Elevated levels of EDA are associated with various diseases and disorders including psoriasis, rheumatoid arthritis, diabetes, and cancer. In some embodiments, the targeting moiety recognizes fibronectin that contains the EDA isoform and may be utilized to target the chimeric protein or Fc-based chimeric protein complex to diseased cells including cancer cells. In some embodiments, the targeting moiety recognizes fibronectin that contains the EDB isoform. In some embodiments, such targeting moieties may be utilized to target the chimeric protein or Fc-based chimeric protein complex to tumor cells including the tumor neovasculature.

In some embodiments, the targeting moiety recognizes and binds to fibrin. Fibrin is another protein substance often found in the matrix network of the ECM. Fibrin is formed by the action of the protease thrombin on fibrinogen that causes the fibrin to polymerize. In some embodiments, the targeting moiety recognizes one or more epitopes on fibrin. In some embodiments, the targeting moiety recognizes the monomeric as well as the polymerized forms of fibrin.

In some embodiments, the targeting moiety recognizes and binds to laminin. Laminin is a major component of the basal lamina, which is a protein network foundation for cells and organs. Laminins are heterotrimeric proteins that contain an a-chain, a 3-chain, and a y-chain. In some embodiments, the targeting moiety recognizes one or more epitopes on laminin. In some embodiments, the targeting moiety recognizes the monomeric, the dimeric as well as the trimeric forms of laminin.

In some embodiments, the targeting moiety recognizes and binds to a nidogen or entactin. Nidogens/entactins are a family of highly conserved, sulfated glycoproteins. They make up the major structural component of the basement membranes and function to link laminin and collagen IV networks in basement membranes. Members of this family include nidogen-1 and nidogen-2. In some embodiments, the targeting moiety recognizes an epitope on nidogen-1 and/or nidogen-2.

In some embodiments, the targeting moiety comprises an antigen recognition domain that recognizes an epitope present on any of the targets described herein. In some embodiments, the antigen-recognition domain recognizes one or more linear epitopes present on the protein. As used herein, a linear epitope refers to any continuous sequence of amino acids present on the protein. In another embodiment, the antigen-recognition domain recognizes one or more conformational epitopes present on the protein. As used herein, a conformation epitope refers to one or more sections of amino acids (which may be discontinuous) that form a three-dimensional surface with features and/or shapes and/or tertiary structures capable of being recognized by an antigen recognition domain.

In some embodiments, the targeting moiety binds to the full-length and/or mature forms and/or isoforms and/or splice variants and/or fragments and/or any other naturally occurring or synthetic analogs, variants, or mutants of any of the described herein. In some embodiments, the targeting moiety may bind to any forms of the proteins described herein, including monomeric, dimeric, trimeric, tetrameric, heterodimeric, multimeric and associated forms. In some embodiments, the targeting moiety may bind to any post-translationally modified forms of the proteins described herein, such as glycosylated and/or phosphorylated forms.

In some embodiments, the targeting moiety comprises an antigen recognition domain that recognizes extracellular molecules such as DNA. In some embodiments, the targeting moiety comprises an antigen recognition domain that recognizes DNA. In some embodiments, the DNA is shed into the extracellular space from necrotic or apoptotic tumor cells or other diseased cells.

In some embodiments, the targeting moiety comprises an antigen recognition domain that recognizes one or more non-cellular structures associated with atherosclerotic plaques. Two types of atherosclerotic plaques are known. The fibro-lipid (fibro-fatty) plaque is characterized by an accumulation of lipid-laden cells underneath the intima of the arteries. Beneath the endothelium there is a fibrous cap covering the atheromatous core of the plaque. The core includes lipid-laden cells (macrophages and smooth muscle cells) with elevated tissue cholesterol and cholesterol ester content, fibrin, proteoglycans, collagen, elastin, and cellular debris. In advanced plaques, the central core of the plaque usually contains extracellular cholesterol deposits (released from dead cells), which form areas of cholesterol crystals with empty, needle-like clefts. At the periphery of the plaque are younger foamy cells and capillaries. A fibrous plaque is also localized under the intima, within the wall of the artery resulting in thickening and expansion of the wall and, sometimes, spotty localized narrowing of the lumen with some atrophy of the muscular layer. The fibrous plaque contains collagen fibers (eosinophilic), precipitates of calcium (hematoxylinophilic) and lipid-laden cells. In some embodiments, the targeting moiety recognizes and binds to one or more of the non-cellular components of these plaques such as the fibrin, proteoglycans, collagen, elastin, cellular debris, and calcium or other mineral deposits or precipitates. In some embodiments, the cellular debris is a nucleic acid, e.g. DNA or RNA, released from dead cells.

In some embodiments, the targeting moiety comprises an antigen recognition domain that recognizes one or more non-cellular structures found in the brain plaques associated with neurodegenerative diseases. In some embodiments, the targeting moiety recognizes and binds to one or more non-cellular structures located in the amyloid plaques found in the brains of patients with Alzheimer's disease. For example, the targeting moiety may recognize and bind to the peptide amyloid beta, which is a major component of the amyloid plaques. In some embodiments, the targeting moiety recognizes and binds to one or more non-cellular structures located in the brains plaques found in patients with Huntington's disease. In some embodiments, the targeting moiety recognizes and binds to one or more non-cellular structures found in plaques associated with other neurodegenerative or musculoskeletal diseases such as Lewy body dementia and inclusion body myositis.

Linkers and Functional Groups

In some embodiments, the FAP binding agent may include one or more functional groups, residues, or moieties. In some embodiments, the one or more functional groups, residues, or moieties are attached or genetically fused to any of the signaling agents or targeting moieties described herein. In some embodiments, such functional groups, residues or moieties confer one or more desired properties or functionalities to the FAP binding agent of the present technology. Examples of such functional groups and of techniques for introducing them into the FAP binding agent are known in the art, for example, see Remington's Pharmaceutical Sciences, 16th ed., Mack Publishing Co., Easton, Pa. (1980).

In some embodiments, the FAP binding agent may by conjugated and/or fused with another agent to extend half-life or otherwise improve pharmacodynamic and pharmacokinetic properties. In some embodiments, the FAP binding agent may be fused or conjugated with one or more of PEG, XTEN (e.g., as rPEG), polysialic acid (POLYXEN), albumin (e.g., human serum albumin or HAS), elastin-like protein (ELP), PAS, HAP, GLK, CTP, transferrin, and the like. In some embodiments, each of the individual chimeric proteins or Fc-based chimeric protein complexes is fused to one or more of the agents described in BioDrugs (2015) 29:215-239, the entire contents of which are hereby incorporated by reference.

In some embodiments, the functional groups, residues, or moieties comprise a suitable pharmacologically acceptable polymer, such as poly(ethyleneglycol) (PEG) or derivatives thereof (such as methoxypoly(ethyleneglycol) or mPEG). In some embodiments, attachment of the PEG moiety increases the half-life and/or reduces the immunogenicity of the FAP binding protein. Generally, any suitable form of pegylation can be used, such as the pegylation used in the art for antibodies and antibody fragments (including but not limited to single domain antibodies such as VHHs); see, for example, Chapman, Nat. Biotechnol., 54, 531-545 (2002); by Veronese and Harris, Adv. Drug Deliv. Rev. 54, 453-456 (2003), by Harris and Chess, Nat. Rev. Drug. Discov., 2, (2003) and in WO04060965, the entire contents of which are hereby incorporated by reference. Various reagents for pegylation of proteins are also commercially available, for example, from Nektar Therapeutics, USA. In some embodiments, site-directed pegylation is used, in particular via a cysteine-residue (see, for example, Yang et al., Protein Engineering, 16, 10, 761-770 (2003), the entire contents of which is hereby incorporated by reference). For example, for this purpose, PEG may be attached to a cysteine residue that naturally occurs in the FAP binding agent of the present technology. In some embodiments, the FAP binding agent of the present technology is modified so as to suitably introduce one or more cysteine residues for attachment of PEG, or an amino acid sequence comprising one or more cysteine residues for attachment of PEG may be fused to the amino- and/or carboxy-terminus of the FAP binding agent, using techniques known in the art.

In some embodiments, the functional groups, residues, or moieties comprise N-linked or O-linked glycosylation. In some embodiments, the N-linked or O-linked glycosylation is introduced as part of a co-translational and/or post-translational modification.

In some embodiments, the functional groups, residues, or moieties comprise one or more detectable labels or other signal-generating groups or moieties. Suitable labels and techniques for attaching, using and detecting them are known in the art and, include, but are not limited to, fluorescent labels (such as fluorescein, isothiocyanate, rhodamine, phycoerythrin, phycocyanin, allophycocyanin, o-phthaldehyde, and fluorescamine and fluorescent metals such as Eu or others metals from the lanthanide series), phosphorescent labels, chemiluminescent labels or bioluminescent labels (such as luminal, isoluminol, theromatic acridinium ester, imidazole, acridinium salts, oxalate ester, dioxetane or GFP and its analogs), radio-isotopes, metals, metals chelates or metallic cations or other metals or metallic cations that are particularly suited for use in vivo, in vitro, or in situ diagnosis and imaging, as well as chromophores and enzymes (such as malate dehydrogenase, staphylococcal nuclease, delta-V-steroid isomerase, yeast alcohol dehydrogenase, alpha-glycerophosphate dehydrogenase, triose phosphate isomerase, biotinavidin peroxidase, horseradish peroxidase, alkaline phosphatase, asparaginase, glucose oxidase, beta-galactosidase, ribonuclease, urease, catalase, glucose-VI-phosphate dehydrogenase, glucoamylase and acetylcholine esterase). Other suitable labels include moieties that can be detected using NMR or ESR spectroscopy. Such labeled VHHs and polypeptides of the present technology may, for example, be used for in vitro, in vivo, or in situ assays (including immunoassays known per se such as ELISA, RIA, EIA and other "sandwich assays," etc.) as well as in vivo diagnostic and imaging purposes, depending on the choice of the specific label.

In some embodiments, the functional groups, residues, or moieties comprise a tag that is attached or genetically fused to the FAP binding agent. In some embodiments, the FAP binding agent may include a single tag or multiple tags. The tag for example is a peptide, sugar, or DNA molecule that does not inhibit or prevent binding of the FAP binding agent to FAP or any other antigen of interest such as tumor antigens. In some embodiments, the tag is at least about: three to five amino acids long, five to eight amino acids long, eight to twelve amino acids long, twelve to fifteen amino acids long, or fifteen to twenty amino acids long. Illustrative tags are described for example, in U.S. Patent Publication No. US2013/0058962. In some embodiment, the tag is an affinity tag such as glutathione-S-transferase (GST) and histidine (His) tag. In an embodiment, the FAP binding agent comprises a His tag.

In some embodiments, the functional groups, residues, or moieties comprise a chelating group, for example, to chelate one of the metals or metallic cations. By way of example, but not by way of limitation, in some embodiments, the chelating groups are diethyl-enetriaminepentaacetic acid (DTPA) or ethylenediaminetetraacetic acid (EDTA).

In some embodiments, the functional groups, residues, or moieties comprise a functional group that is one part of a specific binding pair, such as the biotin-(strept)avidin binding pair. Such a functional group may be used to link the FAP binding agent of the present technology to another protein, polypeptide or chemical compound that is bound to the other half of the binding pair, i.e., through formation of the binding pair. For example, in some embodiments, a FAP binding agent of the present technology may be conjugated to biotin, and linked to another protein, polypeptide, compound or carrier conjugated to avidin or streptavidin. For example, such a conjugated FAP binding agent may be used as a reporter, for example, in a diagnostic system where a detectable signal-producing agent is conjugated to avidin or streptavidin. Such binding pairs may, for example, also be used to bind the FAP binding agent to a carrier, including carriers suitable for pharmaceutical purposes. One non-limiting example are the liposomal formulations described by Cao and Suresh, Journal of Drug Targeting, 8, 4, 257 (2000). Such binding pairs may also be used to link a therapeutically active agent to the FAP binding agent of the present technology.

In some embodiments, the present FAP binding agent optionally comprises one or more linkers. In some embodiments, the FAP binding agent includes a linker that connects each binding region and/or targeting moieties. In some embodiments, the FAP binding agent includes a linker that connects each signaling agent and targeting moiety (or, if more than one targeting moiety, a signaling agent to one of the targeting moieties). In some embodiments, the linker may be utilized to link various functional groups, residues, or moieties as described herein to the FAP binding agent. In some embodiments, the linker is a single amino acid or a plurality of amino acids that does not affect or reduce the stability, orientation, binding, neutralization, and/or clearance characteristics of the binding regions and the binding protein. In some embodiments, the linker is selected from a peptide, a protein, a sugar, or a nucleic acid.

In some embodiments, the present FAP binding agent comprises a linker connecting the targeting moiety and the signaling agent. In other embodiments, the Fc-based chimeric protein complex comprises a linker connecting the targeting moiety to the Fc domain or a linker connecting the signaling moiety to the Fc domain. In some embodiments, the present chimeric protein or Fc-based chimeric protein complex comprises a linker within the signaling agent (e.g. in the case of single chain TNF, which can comprise two linkers to yield a trimer).

The present technology contemplates the use of a variety of linker sequences. In some embodiments, the linker may be derived from naturally-occurring multi-domain proteins or are empirical linkers as described, for example, in Chichili et al., (2013), Protein Sci. 22(2):153-167, Chen et al., (2013), Adv Drug Deliv Rev. 65(10):1357-1369, the entire contents of which are hereby incorporated by reference. In some embodiments, the linker may be designed using linker designing databases and computer programs such as those described in Chen et al., (2013), Adv Drug Deliv Rev. 65(10):1357-1369 and Crasto et al., (2000), Protein Eng. 13(5):309-312, the entire contents of which are hereby incorporated by reference. In some embodiments, the linker may be functional. For example, without limitation, the linker may function to improve the folding and/or stability, improve the expression, improve the pharmacokinetics, and/or improve the bioactivity of the present FAP binding agent.

In some embodiments, the linker is a polypeptide. In some embodiments, the linker is less than about 100 amino acids long. For example, in some embodiments, the linker is less than about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids long. In some embodiments, the linker is a polypeptide. In some embodiments, the linker is greater than about 100 amino acids long. For example, in some embodiments, the linker is greater than about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids long. In some embodiments, the linker is flexible. In another embodiment, the linker is rigid.

In some embodiments, the linker length allows for efficient binding of a targeting moiety and the signaling agent to their receptors. For instance, in some embodiments, the linker length allows for efficient binding of one of the targeting moieties and the signaling agent to receptors on the same cell as well as the efficient binding of the other targeting moiety to another cell. Illustrative pairs of cells are provided elsewhere herein.

In some embodiments, the linker length is at least equal to the minimum distance between the binding sites of one of the targeting moieties and the signaling agent to receptors on the same cell. In some embodiments, the linker length is at least twice, or three times, or four times, or five times, or ten times, or twenty times, or 25 times, or 50 times, or one hundred times, or more the minimum distance between the binding sites of one of the targeting moieties and the signaling agent to receptors on the same cell.

In some embodiments, a linker connects the two targeting moieties to each other and this linker has a short length and a linker connects a targeting moiety and a signaling agent this linker is longer than the linker connecting the two targeting moieties. For example, in some embodiments, the difference in amino acid length between the linker connecting the two targeting moieties and the linker connecting a targeting moiety and a signaling agent may be about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids. In some embodiments, the linker is flexible. In another embodiment, the linker is rigid.

In some embodiments, the linker is substantially comprised of glycine and serine residues (e.g. about 30%, or about 40%, or about 50%, or about 60%, or about 70%, or about 80%, or about 90%, or about 95%, or about 97% glycines and serines). For example, in some embodiments, the linker is (Gly4Ser)$_n$, where n is from about 1 to about 8, e.g. 1, 2, 3, 4, 5, 6, 7, or 8 (SEQ ID NO: 810 to SEQ ID NO: 817). In some embodiments, the linker sequence is GGSGGSGGGGSGGGGS (SEQ ID NO: 818). In some embodiments, the linkers include, but are not limited to, linkers having the sequence LE, GGGGS (SEQ ID NO: 810), (GGGGS)$_n$ (n=1-4) (SEQ ID NO: 810-813), (Gly)$_8$ (SEQ ID NO: 819), (Gly)$_6$ (SEQ ID NO: 820), (EAAAK)$_n$ (n=1-3) (SEQ ID NO: 821-823):, A(EAAAK)$_n$A (n=2-5) (SEQ ID NO: 824-827), AEAAAKEAAAKA (SEQ ID NO: 824), A(EAAAK)$_4$ALEA(EAAAK)$_4$A (SEQ ID NO: 828), PAPAP (SEQ ID NO: 829), KESGSVSSEQLAQFRSLD (SEQ ID NO: 830), EGKSSGSGSESKST (SEQ ID NO: 831), GSAGSAAGSGEF (SEQ ID NO: 832), and (XP)$_n$, with X designating any amino acid, e.g., Ala, Lys, or Glu. In some embodiments, the linker is GGS.

In some embodiments, the linker is one or more of GGGSE (SEQ ID NO: 833), GSESG (SEQ ID NO: 834), GSEGS (SEQ ID NO: 835), GEGGSGEGSSGEGSSSEGGGSEGGGSEGGGSEGGS (SEQ ID NO: 836), and a linker of randomly placed G, S, and E every four amino acid intervals.

In some embodiments, the linker is a hinge region of an antibody (e.g., of IgG, IgA, IgD, and IgE, inclusive of subclasses (e.g. IgG1, IgG2, IgG3, and IgG4, and IgA1 and IgA2)). In some embodiments, the linker is a hinge region of an antibody (e.g., of IgG, IgA, IgD, and IgE, inclusive of subclasses (e.g. IgG1, IgG2, IgG3, and IgG4, and IgA1 and IgA2)). Without wishing to be bound by theory, in some embodiments, the hinge region, found in IgG, IgA, IgD, and IgE class antibodies, acts as a flexible spacer, allowing the Fab portion to move freely in space. In contrast to the constant regions, the hinge domains are structurally diverse, varying in both sequence and length among immunoglobulin classes and subclasses. For example, the length and flexibility of the hinge region varies among the IgG subclasses. The hinge region of IgG1 encompasses amino acids 216-231 and, because it is freely flexible, the Fab fragments can rotate about their axes of symmetry and move within a sphere centered at the first of two inter-heavy chain disulfide bridges.

IgG2 has a shorter hinge than IgG1, with 12 amino acid residues and four disulfide bridges. The hinge region of IgG2 lacks a glycine residue, is relatively short, and contains a rigid poly-proline double helix, stabilized by extra inter-heavy chain disulfide bridges. These properties restrict the flexibility of the IgG2 molecule. IgG3 differs from the other subclasses by its unique extended hinge region (about four times as long as the IgG1 hinge), containing 62 amino acids (including 21 prolines and 11 cysteines), forming an inflexible poly-proline double helix. In IgG3, the Fab fragments are relatively far away from the Fc fragment, giving the molecule a greater flexibility. The elongated hinge in IgG3 is also responsible for its higher molecular weight compared to the other subclasses. The hinge region of IgG4 is shorter than that of IgG1 and its flexibility is intermediate between that of IgG1 and IgG2. The flexibility of the hinge regions reportedly decreases in the order IgG3>IgG1>IgG4>IgG2.

According to crystallographic studies, the immunoglobulin hinge region can be further subdivided functionally into three regions: the upper hinge region, the core region, and the lower hinge region. See Shin et al., 1992 Immunological Reviews 130:87. The upper hinge region includes amino acids from the carboxyl end of $C_{H1}$ to the first residue in the hinge that restricts motion, generally the first cysteine residue that forms an interchain disulfide bond between the two heavy chains. The length of the upper hinge region correlates with the segmental flexibility of the antibody. The core hinge region contains the inter-heavy chain disulfide bridges, and the lower hinge region joins the amino terminal end of the $C_{H2}$ domain and includes residues in $C_{H2}$. The core hinge region of wild-type human IgG1 contains the sequence Cys-Pro-Pro-Cys, which, when dimerized by disulfide bond formation, results in a cyclic octapeptide believed to act as a pivot, thus conferring flexibility. In some embodiments, the present linker comprises, one, or two, or three of the upper hinge region, the core region, and the lower hinge region of any antibody (e.g., of IgG, IgA, IgD, and IgE, inclusive of subclasses (e.g. IgG1, IgG2, IgG3, and IgG4, and IgA1 and IgA2)). The hinge region may also contain one or more glycosylation sites, which include a number of structurally distinct types of sites for carbohydrate attachment. For example, IgA1 contains five glycosylation sites within a 17-amino-acid segment of the hinge region, conferring resistance of the hinge region polypeptide to intestinal proteases, considered an advantageous property for a secretory immunoglobulin. In some embodiments, the linker of the present technology comprises one or more glycosylation sites. In some embodiments, the linker is a hinge-CH2-CH3 domain of a human IgG4 antibody.

In some embodiments, the present FAP binding agent is linked to an antibody Fc domain, comprising one or both of $C_H2$ and $C_H3$ domains, and optionally a hinge region. For example, vectors encoding the present FAP binding agents linked as a single nucleotide sequence to an Fc domain can be used to prepare such polypeptides.

In some embodiments, the linker is a synthetic linker such as PEG.

In some embodiments, the linker may be functional. For example, in some embodiments, the linker functions to improve the folding and/or stability, improve the expression, improve the pharmacokinetics, and/or improve the bioactivity of the present FAP binding agent. In another example, the linker may function to target the FAP binding agent to a particular cell type or location.

Modifications and Production of FAP Binding Agents

In some embodiments, the FAP binding agent comprises a targeting moiety that is a VHH. In some embodiments, the VHH is not limited to a specific biological source or to a specific method of preparation. For example, the VHH can generally be obtained: (1) by isolating the VHH domain of a naturally occurring heavy chain antibody; (2) by expression of a nucleotide sequence encoding a naturally occurring VHH domain; (3) by "humanization" of a naturally occurring VHH domain or by expression of a nucleic acid encoding a such humanized VHH domain; (4) by "camel-ization" of a naturally occurring VH domain from any animal species, such as from a mammalian species, such as from a human being, or by expression of a nucleic acid encoding such a camelized VH domain; (5) by "cameliza-tion" of a "domain antibody" or "Dab" as described in the art, or by expression of a nucleic acid encoding such a camelized VH domain; (6) by using synthetic or semi-synthetic techniques for preparing proteins, polypeptides or other amino acid sequences known in the art; (7) by pre-paring a nucleic acid encoding a VHH using techniques for nucleic acid synthesis known in the art, followed by expres-sion of the nucleic acid thus obtained; and/or (8) by any combination of one or more of the foregoing.

In an embodiment, the FAP binding agent comprises a VHH that corresponds to the VHH domains of naturally occurring heavy chain antibodies directed against human FAP. In some embodiments, such VHH sequences can generally be generated or obtained by suitably immunizing a species of Camelid with a FAP molecule, (i.e., so as to raise an immune response and/or heavy chain antibodies directed against FAP), by obtaining a suitable biological sample from the Camelid (such as a blood sample, or any sample of B-cells), and by generating VHH sequences directed against FAP, starting from the sample, using any suitable known techniques. In some embodiments, naturally occurring VHH domains against FAP can be obtained from naive libraries of Camelid VHH sequences, for example, by screening such a library using FAP or at least one part, fragment, antigenic determinant or epitope thereof using one or more screening techniques known in the art. Such libraries and techniques are, for example, described in WO 9937681, WO 0190190, WO 03025020 and WO 03035694, the entire contents of which are hereby incorporated by reference. In some embodiments, improved synthetic or semi-synthetic librar-ies derived from naive VHH libraries may be used, such as VHH libraries obtained from naive VHH libraries by tech-niques such as random mutagenesis and/or CDR shuffling, as for example, described in WO 0043507, the entire con-tents of which are hereby incorporated by reference. In some embodiments, another technique for obtaining VHH sequences directed against a FAP involves suitably immu-nizing a transgenic mammal that is capable of expressing heavy chain antibodies (i.e., so as to raise an immune response and/or heavy chain antibodies directed against FAP), obtaining a suitable biological sample from the trans-genic mammal (such as a blood sample, or any sample of B-cells), and then generating VHH sequences directed against FAP starting from the sample, using any suitable known techniques. For example, for this purpose, the heavy chain antibody-expressing mice and the further methods and techniques described in WO 02085945 and in WO 04049794 (the entire contents of which are hereby incorporated by reference) can be used.

In an embodiment, the FAP binding agent comprises a VHH that has been "humanized" i.e., by replacing one or more amino acid residues in the amino acid sequence of the naturally occurring VHH sequence (and in particular in the framework sequences) by one or more of the amino acid residues that occur at the corresponding position(s) in a VH domain from a conventional 4-chain antibody from a human being. This can be performed using humanization tech-niques known in the art. In some embodiments, possible humanizing substitutions or combinations of humanizing substitutions may be determined by methods known in the art, for example, by a comparison between the sequence of a VHH and the sequence of a naturally occurring human VH domain. In some embodiments, the humanizing substitutions are chosen such that the resulting humanized VHHs still retain advantageous functional properties. Generally, as a result of humanization, the VHHs of the present technol-ogy may become more "human-like," while still retaining favorable properties such as a reduced immunogenicity, compared to the corresponding naturally occurring VHH domains. In some embodiments, the humanized VHHs of the present technology can be obtained in any suitable manner known in the art and thus are not strictly limited to polypeptides that have been obtained using a polypeptide that comprises a naturally occurring VHH domain as a starting material.

In some embodiments, the FAP binding agent comprises a VHH that has been "camelized," i.e., by replacing one or more amino acid residues in the amino acid sequence of a naturally occurring VH domain from a conventional 4-chain antibody by one or more of the amino acid residues that occur at the corresponding position(s) in a VHH domain of a heavy chain antibody of a camelid. In some embodiments, such "camelizing" substitutions are inserted at amino acid positions that form and/or are present at the VH-VL inter-face, and/or at the so-called Camelidae hallmark residues (see, for example, WO 9404678, the entire contents of which are hereby incorporated by reference). In some embodi-ments, the VH sequence that is used as a starting material or starting point for generating or designing the camelized VHH is a VH sequence from a mammal, for example, the VH sequence of a human being, such as a VH3 sequence. In some embodiments, the camelized VHHs can be obtained in any suitable manner known in the art (i.e., as indicated under points (1)-(8) above) and thus are not strictly limited to polypeptides that have been obtained using a polypeptide that comprises a naturally occurring VH domain as a starting material.

In some embodiments, both "humanization" and "camel-ization" can be performed by providing a nucleotide sequence that encodes a naturally occurring VHH domain or VH domain, respectively, and then changing, in a manner known in the art, one or more codons in the nucleotide sequence in such a way that the new nucleotide sequence encodes a "humanized" or "camelized" VHH, respectively. This nucleic acid can then be expressed in a manner known in the art, so as to provide the desired VHH of the present technology. Alternatively, based on the amino acid sequence of a naturally occurring VHH domain or VH domain, respectively, the amino acid sequence of the desired human-ized or camelized VHH of the present technology, respec-tively, can be designed and then synthesized de novo using techniques for peptide synthesis known in the art. Also, based on the amino acid sequence or nucleotide sequence of a naturally occurring VHH domain or VH domain, respec-tively, a nucleotide sequence encoding the desired human-ized or camelized VHH, respectively, can be designed and then synthesized de novo using techniques for nucleic acid synthesis known in the art, after which the nucleic acid thus obtained can be expressed in a manner known in the art, so as to provide the desired VHH of the present technology. Other suitable methods and techniques for obtaining the VHHs of the present technology and/or nucleic acids encod-ing the same, starting from naturally occurring VH sequences or VHH sequences, are known in the art, and may, for example, comprise combining one or more parts of one or more naturally occurring VH sequences (such as one or more FR sequences and/or CDR sequences), one or more parts of one or more naturally occurring VHH sequences (such as one or more FR sequences or CDR sequences), and/or one or more synthetic or semi-synthetic sequences, in a suitable manner, so as to provide a VHH of the present technology or a nucleotide sequence or nucleic acid encoding the same.

Methods for producing the FAP binding agents of the present technology are described herein. For example, DNA sequences encoding the FAP binding agents of the present technology can be chemically synthesized using methods known in the art. Synthetic DNA sequences can be ligated to other appropriate nucleotide sequences, including, e.g., expression control sequences, to produce gene expression constructs encoding the desired FAP binding agents. Accordingly, in some embodiments, the present technology provides for isolated nucleic acids comprising a nucleotide sequence encoding the FAP binding agent of the present technology.

Nucleic acids encoding the FAP binding agent of the present technology can be incorporated (ligated) into expression vectors, which can be introduced into host cells through transfection, transformation, or transduction techniques. For example, nucleic acids encoding the FAP binding agent of the present technology can be introduced into host cells by retroviral transduction. Illustrative host cells are E. coli cells, Chinese hamster ovary (CHO) cells, human embryonic kidney 293 (HEK 293) cells, HeLa cells, baby hamster kidney (BH K) cells, monkey kidney cells (COS), human hepatocellular carcinoma cells (e.g., Hep G2), and myeloma cells. Transformed host cells can be grown under conditions that permit the host cells to express the genes that encode the FAP binding agent of the present technology. Accordingly, in some embodiments, the present technology provides expression vectors comprising nucleic acids that encode the FAP binding agent of the present technology. In some embodiments, the present technology additional provides host cells comprising such expression vectors.

Specific expression and purification conditions will vary depending upon the expression system employed. For example, if a gene is to be expressed in E. coli, it is first cloned into an expression vector by positioning the engineered gene downstream from a suitable bacterial promoter, e.g., Trp or Tac, and a prokaryotic signal sequence. In another example, if the engineered gene is to be expressed in eukaryotic host cells, e.g., CHO cells, it is first inserted into an expression vector containing for example, a suitable eukaryotic promoter, a secretion signal, enhancers, and various introns. The gene construct can be introduced into the host cells using transfection, transformation, or transduction techniques.

The FAP binding agent of the present technology can be produced by growing a host cell transfected with an expression vector encoding the FAP binding agent under conditions that permit expression of the protein. Following expression, the protein can be harvested and purified using techniques well known in the art, e.g., affinity tags such as Glutathione-S-transferase (GST) and histidine (His) tags or by chromatography. In an embodiment, the FAP binding agent comprises a His tag. In some embodiments, the FAP binding agent comprises a His tag and a proteolytic site to allow cleavage of the His tag.

Accordingly, in some embodiments, the present technology provides for a nucleic acid encoding a FAP binding agent of the present technology. In some embodiments, the present technology provides for a host cell comprising a nucleic acid encoding a FAP binding agent of the present technology.

In some embodiments, the present FAP binding agent or chimeric protein or Fc-based chimeric protein complex comprising the same may be expressed in vivo, for instance, in a patient. For example, in some embodiments, the present FAP binding agent or chimeric protein or Fc-based chimeric protein complex comprising the same may administered in the form of nucleic acid which encodes the present FAP binding agents or chimeric proteins or Fc-based chimeric protein complex comprising the same. In some embodiments, the nucleic acid is DNA or RNA. In some embodiments, present FAP binding agent or chimeric protein or Fc-based chimeric protein complex comprising the same is encoded by a modified mRNA, i.e. an mRNA comprising one or more modified nucleotides. In some embodiments, the modified mRNA comprises one or modifications found in U.S. Pat. No. 8,278,036, the entire contents of which are hereby incorporated by reference. In some embodiments, the modified mRNA comprises one or more of m5C, m5U, m6A, s2U, ψ, and 2'-O-Methyl-U. In some embodiments, the present technology relates to administering a modified mRNA encoding one or more of the present chimeric proteins or Fc-based chimeric protein complex. In some embodiments, the present technology relates to gene therapy vectors comprising the same. In some embodiments, the present technology relates to gene therapy methods comprising the same. In some embodiments, the nucleic acid is in the form of an oncolytic virus, e.g. an adenovirus, reovirus, measles, herpes simplex, Newcastle disease virus or vaccinia.

Pharmaceutically Acceptable Salts and Excipients

The FAP binding agents (and/or any other therapeutic agents) described herein can possess a sufficiently basic functional group, which can react with an inorganic or organic acid, or a carboxyl group, which can react with an inorganic or organic base, to form a pharmaceutically acceptable salt. A pharmaceutically acceptable acid addition salt is formed from a pharmaceutically acceptable acid, as is well known in the art. Such salts include the pharmaceutically acceptable salts listed in, for example, Journal of Pharmaceutical Science, 66, 2-19 (1977) and The Handbook of Pharmaceutical Salts; Properties, Selection, and Use. P. H. Stahl and C. G. Wermuth (eds.), Verlag, Zurich (Switzerland) 2002, which are hereby incorporated by reference in their entirety.

Pharmaceutically acceptable salts include, by way of non-limiting example, sulfate, citrate, acetate, oxalate, chloride, bromide, iodide, nitrate, bisulfate, phosphate, acid phosphate, isonicotinate, lactate, salicylate, acid citrate, tartrate, oleate, tannate, pantothenate, bitartrate, ascorbate, succinate, maleate, gentisinate, fumarate, gluconate, glucaronate, saccharate, formate, benzoate, glutamate, methanesulfonate, ethanesulfonate, benzenesulfonate, p-toluenesulfonate, camphorsulfonate, pamoate, phenylacetate, trifluoroacetate, acrylate, chlorobenzoate, dinitrobenzoate, hydroxybenzoate, methoxybenzoate, methylbenzoate, o-acetoxybenzoate, naphthalene-2-benzoate, isobutyrate, phenylbutyrate, a-hydroxybutyrate, butyne-1,4-dicarboxylate, hexyne-1,4-dicarboxylate, caprate, caprylate, cinnamate, glycollate, heptanoate, hippurate, malate, hydroxymaleate, malonate, mandelate, mesylate, nicotinate, phthalate, teraphthalate, propiolate, propionate, phenylpropionate, sebacate, suberate, p-bromobenzenesulfonate, chlorobenzenesulfonate, ethylsulfonate, 2-hydroxyethylsulfonate, methylsulfonate, naphthalene-1-sulfonate, naphthalene-2-sulfonate, naphthalene-1,5-sulfonate, xylenesulfonate, and tartarate salts.

The term "pharmaceutically acceptable salt" also refers to a salt of the compositions of the present technology having an acidic functional group, such as a carboxylic acid functional group, and a base. Suitable bases include, but are not limited to, hydroxides of alkali metals such as sodium, potassium, and lithium; hydroxides of alkaline earth metal such as calcium and magnesium; hydroxides of other metals, such as aluminum and zinc; ammonia, and organic amines, such as unsubstituted or hydroxy-substituted mono-, di-, or tri-alkylamines, dicyclohexylamine; tributyl amine; pyridine; N-methyl, N-ethylamine; diethylamine; triethylamine; mono-, bis-, or tris-(2-OH-lower alkylamines), such as mono-; bis-, or tris-(2-hydroxyethyl)amine, 2-hydroxy-tert-butylamine, or tris-(hydroxymethyl)methylamine, N,N-di-lower alkyl-N-(hydroxyl-lower alkyl)-amines, such as N,N-dimethyl-N-(2-hydroxyethyl)amine or tri-(2-hydroxyethyl) amine; N-methyl-D-glucamine; and amino acids such as arginine, lysine, and the like.

In some embodiments, the compositions described herein are in the form of a pharmaceutically acceptable salt.

Pharmaceutical Compositions and Formulations

In some embodiments, the present technology pertains to pharmaceutical compositions comprising the FAP binding agents (and/or any other therapeutic agents) described herein and a pharmaceutically acceptable carrier or excipient. In some embodiments, the present technology pertains to pharmaceutical compositions comprising the present FAP binding agents. In another embodiment, the present technology pertains to pharmaceutical compositions comprising any other therapeutic agents described herein. In a further embodiment, the present technology pertains to pharmaceutical compositions comprising a combination of the present FAP binding agents and any other therapeutic agents described herein. Any pharmaceutical compositions described herein can be administered to a subject as a component of a composition that comprises a pharmaceutically acceptable carrier or vehicle. Such compositions can optionally comprise a suitable amount of a pharmaceutically acceptable excipient so as to provide the form for proper administration.

In some embodiments, pharmaceutical excipients can be liquids, such as water and oils, including those of petroleum, animal, vegetable, or synthetic origin, such as peanut oil, soybean oil, mineral oil, sesame oil and the like. The pharmaceutical excipients can be, for example, saline, gum acacia, gelatin, starch paste, talc, keratin, colloidal silica, urea and the like. In addition, auxiliary, stabilizing, thickening, lubricating, and coloring agents can be used. In one embodiment, the pharmaceutically acceptable excipients are sterile when administered to a subject. Water is a useful excipient when any agent described herein is administered intravenously. Saline solutions and aqueous dextrose and glycerol solutions can also be employed as liquid excipients, specifically for injectable solutions. Suitable pharmaceutical excipients also include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. Any agent described herein, if desired, can also comprise minor amounts of wetting or emulsifying agents, or pH buffering agents. Other examples of suitable pharmaceutical excipients are described in Remington's Pharmaceutical Sciences 1447-1676 (Alfonso R. Gennaro eds., 19th ed. 1995), incorporated herein by reference.

The present technology includes the described pharmaceutical compositions (and/or additional therapeutic agents) in various formulations. Any inventive pharmaceutical composition (and/or additional therapeutic agents) described herein can take the form of solutions, suspensions, emulsion, drops, tablets, pills, pellets, capsules, capsules containing liquids, gelatin capsules, powders, sustained-release formulations, suppositories, emulsions, aerosols, sprays, suspensions, lyophilized powder, frozen suspension, desiccated powder, or any other form suitable for use. In one embodiment, the composition is in the form of a capsule. In another embodiment, the composition is in the form of a tablet. In yet another embodiment, the pharmaceutical composition is formulated in the form of a soft-gel capsule. In a further embodiment, the pharmaceutical composition is formulated in the form of a gelatin capsule. In yet another embodiment, the pharmaceutical composition is formulated as a liquid.

In some embodiments, the inventive pharmaceutical compositions (and/or additional agents) can also include a solubilizing agent. Also, the agents can be delivered with a suitable vehicle or delivery device as known in the art. Combination therapies outlined herein can be co-delivered in a single delivery vehicle or delivery device.

The formulations comprising the inventive pharmaceutical compositions (and/or additional agents) of the present technology may conveniently be presented in unit dosage forms and may be prepared by any of the methods well known in the art of pharmacy. Such methods generally include the step of bringing the therapeutic agents into association with a carrier, which constitutes one or more accessory ingredients. Typically, the formulations are prepared by uniformly and intimately bringing the therapeutic agent into association with a liquid carrier, a finely divided solid carrier, or both, and then, if necessary, shaping the product into dosage forms of the desired formulation (e.g., wet or dry granulation, powder blends, etc., followed by tableting using conventional methods known in the art).

In some embodiments, any pharmaceutical compositions (and/or additional agents) described herein is formulated in accordance with routine procedures as a composition adapted for a mode of administration described herein.

In some embodiments, the routes of administration include, for example: oral, intradermal, intramuscular, intraperitoneal, intravenous, subcutaneous, intranasal, epidural, sublingual, intranasal, intracerebral, intravaginal, transdermal, rectally, by inhalation, or topically. Administration can be local or systemic. In some embodiments, the administering is effected orally. In another embodiment, the administration is by parenteral injection. The mode of administration can be left to the discretion of the practitioner, and depends in-part upon the site of the medical condition. In most instances, administration results in the release of any agent described herein into the bloodstream.

In some embodiments, the FAP binding agent described herein is formulated in accordance with routine procedures as a composition adapted for oral administration. By way of example, but not by way of limitation, in some embodiments, compositions for oral delivery are in the form of tablets, lozenges, aqueous or oily suspensions, granules, powders, emulsions, capsules, syrups, or elixirs. In some embodiments, orally administered compositions include one or more agents, for example, sweetening agents such as fructose, aspartame or saccharin; flavoring agents such as peppermint, oil of wintergreen, or cherry; coloring agents; and preserving agents, to provide a pharmaceutically palatable preparation. In some embodiments, the compositions, when in tablet or pill form, are coated to delay disintegration and absorption in the gastrointestinal tract thereby providing a sustained action over an extended period of time. Selectively permeable membranes surrounding an osmotically active driving any FAP binding agents described herein are also suitable for orally administered compositions. In these latter platforms, fluid from the environment surrounding the capsule is imbibed by the driving compound, which swells to displace the agent or agent composition through an aperture. These delivery platforms can provide an essentially zero order delivery profile as opposed to the spiked profiles of immediate release formulations. In some embodiments, the oral compositions include a time-delay material, such as, e.g., glycerol monostearate or glycerol stearate. In some embodiments, oral compositions include standard excipients such as mannitol, lactose, starch, magnesium stearate, sodium saccharin, cellulose, and magnesium carbonate. In one embodiment, the excipients are of pharmaceutical grade. Suspensions, in addition to the active compounds, may contain suspending agents such as, for example, ethoxylated isostearyl alcohols, polyoxyethylene sorbitol and sorbitan esters, microcrystalline cellulose, aluminum metahydroxide, bentonite, agar-agar, tragacanth, etc., and mixtures thereof.

Dosage forms suitable for parenteral administration (e.g. intravenous, intramuscular, intraperitoneal, subcutaneous and intra-articular injection and infusion) include, for example, solutions, suspensions, dispersions, emulsions, and the like. They may also be manufactured in the form of sterile solid compositions (e.g. lyophilized composition), which can be dissolved or suspended in sterile injectable medium immediately before use. They may contain, for example, suspending or dispersing agents known in the art. Formulation components suitable for parenteral administration include a sterile diluent such as water for injection, saline solution, fixed oils, polyethylene glycols, glycerine, propylene glycol or other synthetic solvents; antibacterial agents such as benzyl alcohol or methyl paraben; antioxidants such as ascorbic acid or sodium bisulfite; chelating agents such as EDTA; buffers such as acetates, citrates or phosphates; and agents for the adjustment of tonicity such as sodium chloride or dextrose.

For intravenous administration, suitable carriers include physiological saline, bacteriostatic water, Cremophor ELTM (BASF, Parsippany, NJ) or phosphate buffered saline (PBS). The carrier should be stable under the conditions of manufacture and storage, and should be preserved against microorganisms. The carrier can be a solvent or dispersion medium containing, for example, water, ethanol, polyol (for example, glycerol, propylene glycol, and liquid polyethylene glycol), and suitable mixtures thereof.

The compositions provided herein, alone or in combination with other suitable components, can be made into aerosol formulations (i.e., "nebulized") to be administered via inhalation. Aerosol formulations can be placed into pressurized acceptable propellants, such as dichlorodifluoromethane, propane, nitrogen, and the like.

Any inventive pharmaceutical compositions (and/or additional agents) described herein can be administered by controlled-release or sustained-release means or by delivery devices that are well known to those of ordinary skill in the art. Examples include, but are not limited to, those described in U.S. Pat. Nos. 3,845,770; 3,916,899; 3,536,809; 3,598,123; 4,008,719; 5,674,533; 5,059,595; 5,591,767; 5,120,548; 5,073,543; 5,639,476; 5,354,556; and 5,733,556, each of which is incorporated herein by reference in its entirety. Such dosage forms can be useful for providing controlled- or sustained-release of one or more active ingredients using, for example, hydropropyl cellulose, hydropropylmethyl cellulose, polyvinylpyrrolidone, other polymer matrices, gels, permeable membranes, osmotic systems, multilayer coatings, microparticles, liposomes, microspheres, or a combination thereof to provide the desired release profile in varying proportions. Suitable controlled- or sustained-release formulations known to those skilled in the art, including those described herein, can be readily selected for use with the active ingredients of the agents described herein. The present technology, thus, provides single unit dosage forms suitable for oral administration such as, but not limited to, tablets, capsules, gelcaps, and caplets that are adapted for controlled- or sustained-release.

Controlled- or sustained-release of an active ingredient can be stimulated by various conditions, including but not limited to, changes in pH, changes in temperature, stimulation by an appropriate wavelength of light, concentration or availability of enzymes, concentration or availability of water, or other physiological conditions or compounds.

In another embodiment, a controlled-release system can be placed in proximity of the target area to be treated, thus requiring only a fraction of the systemic dose (see, e.g., Goodson, in Medical Applications of Controlled Release, supra, vol. 2, pp. 115-138 (1984)). Other controlled-release systems discussed in the review by Langer, 1990, Science 249:1527-1533) may be used.

Pharmaceutical formulations preferably are sterile. Sterilization can be accomplished, for example, by filtration through sterile filtration membranes. Where the composition is lyophilized, filter sterilization can be conducted prior to or following lyophilization and reconstitution.

Administration and Dosage

It will be appreciated that the actual dose of the FAP binding agent and/or any therapeutic agents described herein to be administered according to the present technology will vary according to the particular dosage form, and the mode of administration. Many factors that may modify the action of the FAP binding agent (e.g., body weight, gender, diet, time of administration, route of administration, rate of excretion, condition of the subject, drug combinations, genetic disposition and reaction sensitivities) can be taken into account by those skilled in the art. Administration can be carried out continuously or in one or more discrete doses within the maximum tolerated dose. Optimal administration rates for a given set of conditions can be ascertained by those skilled in the art using conventional dosage administration tests.

In some embodiments, a suitable dosage of the FAP binding agent and/or any therapeutic agents described herein is in a range of about 0.01 mg/kg to about 10 g/kg of body weight of the subject, about 0.01 mg/kg to about 1 g/kg of body weight of the subject, about 0.01 mg/kg to about 100 mg/kg of body weight of the subject, about 0.01 mg/kg to about 10 mg/kg of body weight of the subject, for example, about 0.01 mg/kg, about 0.02 mg/kg, about 0.03 mg/kg, about 0.04 mg/kg, about 0.05 mg/kg, about 0.06 mg/kg, about 0.07 mg/kg, about 0.08 mg/kg, about 0.09 mg/kg, about 0.1 mg/kg, about 0.2 mg/kg, about 0.3 mg/kg, about 0.4 mg/kg, about 0.5 mg/kg, about 0.6 mg/kg, about 0.7 mg/kg, about 0.8 mg/kg, about 0.9 mg/kg, about 1 mg/kg, about 1.1 mg/kg, about 1.2 mg/kg, about 1.3 mg/kg, about 1.4 mg/kg, about 1.5 mg/kg, about 1.6 mg/kg, about 1.7 mg/kg, about 1.8 mg/kg, 1.9 mg/kg, about 2 mg/kg, about 3 mg/kg, about 4 mg/kg, about 5 mg/kg, about 6 mg/kg, about 7 mg/kg, about 8 mg/kg, about 9 mg/kg, about 10 mg/kg body weight, about 100 mg/kg body weight, about 1 g/kg of body weight, about 10 g/kg of body weight, inclusive of all values and ranges therebetween.

In some embodiments, individual doses of the FAP binding agent and/or any therapeutic agents described herein are administered in unit dosage forms containing, for example, from about 0.01 mg to about 100 g, from about 0.01 mg to about 75 g, from about 0.01 mg to about 50 g, from about 0.01 mg to about 25 g, about 0.01 mg to about 10 g, about 0.01 mg to about 7.5 g, about 0.01 mg to about 5 g, about 0.01 mg to about 2.5 g, about 0.01 mg to about 1 g, about 0.01 mg to about 100 mg, from about 0.1 mg to about 100 mg, from about 0.1 mg to about 90 mg, from about 0.1 mg to about 80 mg, from about 0.1 mg to about 70 mg, from about 0.1 mg to about 60 mg, from about 0.1 mg to about 50 mg, from about 0.1 mg to about 40 mg active ingredient, from about 0.1 mg to about 30 mg, from about 0.1 mg to about 20 mg, from about 0.1 mg to about 10 mg, from about 0.1 mg to about 5 mg, from about 0.1 mg to about 3 mg, from about 0.1 mg to about 1 mg per unit dosage form, or from about 5 mg to about 80 mg per unit dosage form. For example, a unit dosage form can be about 0.01 mg, about 0.02 mg, about 0.03 mg, about 0.04 mg, about 0.05 mg, about 0.06 mg, about 0.07 mg, about 0.08 mg, about 0.09 mg, about 0.1 mg, about 0.2 mg, about 0.3 mg, about 0.4 mg, about 0.5 mg, about 0.6 mg, about 0.7 mg, about 0.8 mg, about 0.9 mg, about 1 mg, about 2 mg, about 3 mg, about 4 mg, about 5 mg, about 6 mg, about 7 mg, about 8 mg, about 9 mg about 10 mg, about 15 mg, about 20 mg, about 25 mg, about 30 mg, about 35 mg, about 40 mg, about 45 mg, about 50 mg, about 55 mg, about 60 mg, about 65 mg, about 70 mg, about 75 mg, about 80 mg, about 85 mg, about 90 mg, about 95 mg, about 100 mg, about 200 mg, about 500 mg, about 1 g, about 2.5 g, about 5 g, about 10 g, about 25 g, about 50 g, about 75 g, about 100 g, inclusive of all values and ranges therebetween.

In one embodiment, the FAP binding agent and/or any therapeutic agents described herein are administered at an amount of from about 0.01 mg to about 100 g daily, from about 0.01 mg to about 75 g daily, from about 0.01 mg to about 50 g daily, from about 0.01 mg to about 25 g daily, from about 0.01 mg to about 10 g daily, from about 0.01 mg to about 7.5 g daily, from about 0.01 mg to about 5 g daily, from about 0.01 mg to about 2.5 g daily, from about 0.01 mg to about 1 g daily, from about 0.01 mg to about 100 mg daily, from about 0.1 mg to about 100 mg daily, from about 0.1 mg to about 95 mg daily, from about 0.1 mg to about 90 mg daily, from about 0.1 mg to about 85 mg daily, from about 0.1 mg to about 80 mg daily, from about 0.1 mg to about 75 mg daily, from about 0.1 mg to about 70 mg daily, from about 0.1 mg to about 65 mg daily, from about 0.1 mg to about 60 mg daily, from about 0.1 mg to about 55 mg daily, from about 0.1 mg to about 50 mg daily, from about 0.1 mg to about 45 mg daily, from about 0.1 mg to about 40 mg daily, from about 0.1 mg to about 35 mg daily, from about 0.1 mg to about 30 mg daily, from about 0.1 mg to about 25 mg daily, from about 0.1 mg to about 20 mg daily, from about 0.1 mg to about 15 mg daily, from about 0.1 mg to about 10 mg daily, from about 0.1 mg to about 5 mg daily, from about 0.1 mg to about 3 mg daily, from about 0.1 mg to about 1 mg daily, or from about 5 mg to about 80 mg daily. In some embodiments, the FAP binding agent is adminis- tered at a daily dose of about 0.01 mg, about 0.02 mg, about 0.03 mg, about 0.04 mg, about 0.05 mg, about 0.06 mg, about 0.07 mg, about 0.08 mg, about 0.09 mg, about 0.1 mg, about 0.2 mg, about 0.3 mg, about 0.4 mg, about 0.5 mg, about 0.6 mg, about 0.7 mg, about 0.8 mg, about 0.9 mg, about 1 mg, about 2 mg, about 3 mg, about 4 mg, about 5 mg, about 6 mg, about 7 mg, about 8 mg, about 9 mg about 10 mg, about 15 mg, about 20 mg, about 25 mg, about 30 mg, about 35 mg, about 40 mg, about 45 mg, about 50 mg, about 55 mg, about 60 mg, about 65 mg, about 70 mg, about 75 mg, about 80 mg, about 85 mg, about 90 mg, about 95 mg, about 100 mg, about 200 mg, about 500 mg, about 1 g, about 2.5 g, about 5 g, about 7.5 g, about 10 g, about 25 g, about 50 g, about 75 g, about 100 g, inclusive of all values and ranges therebetween.

In accordance with certain embodiments of the present technology, the pharmaceutical composition comprising the FAP binding agent and/or any therapeutic agents described herein may be administered, for example, more than once daily (e.g., about two times, about three times, about four times, about five times, about six times, about seven times, about eight times, about nine times, or about ten times daily), about once per day, about every other day, about every third day, about once a week, about once every two weeks, about once every month, about once every two months, about once every three months, about once every six months, or about once every year.

Combination Therapy and Additional Therapeutic Agents

In some embodiments, the pharmaceutical composition of the present technology is co-administered in conjunction with one or more additional therapeutic agents. In some embodiments, co-administration can be simultaneous or sequential.

In one embodiment, the additional therapeutic agent and the FAP binding agent of the present technology are admin- istered to a subject simultaneously. The term "simultane- ously" as used herein, means that the additional therapeutic agent and the FAP binding agent are administered with a time separation of no more than about 60 minutes, such as no more than about 30 minutes, no more than about 20 minutes, no more than about 10 minutes, no more than about 5 minutes, or no more than about 1 minute. Administration of the additional therapeutic agent and the FAP binding agent can be by simultaneous administration of a single formulation (e.g., a formulation comprising the additional therapeutic agent and the FAP binding agent) or of separate formulations (e.g., a first formulation including the addi- tional therapeutic agent and a second formulation including the FAP binding agent).

Co-administration does not require the therapeutic agents to be administered simultaneously, if the timing of their administration is such that the pharmacological activities of the additional therapeutic agent and the FAP binding agent overlap in time, thereby exerting a combined therapeutic effect. For example, the additional therapeutic agent and the FAP binding agent can be administered sequentially. The term "sequentially" as used herein means that the additional therapeutic agent and the FAP binding agent are adminis- tered with a time separation of more than about 60 minutes. For example, the time between the sequential administration of the additional therapeutic agent and the FAP binding agent can be more than about 60 minutes, more than about 2 hours, more than about 5 hours, more than about 10 hours, more than about 1 day, more than about 2 days, more than about 3 days, more than about 1 week, or more than about 2 weeks, or more than about one month apart. The optimal administration times will depend on the rates of metabolism, excretion, and/or the pharmacodynamic activity of the addi- tional therapeutic agent and the FAP binding agent being administered. Either the additional therapeutic agent or the FAP binding agent cell may be administered first.

Co-administration also does not require the therapeutic agents to be administered to the subject by the same route of administration. Rather, each therapeutic agent can be admin- istered by any appropriate route, for example, parenterally or non-parenterally.

In some embodiments, the FAP binding agent described herein acts synergistically when co-administered with another therapeutic agent. As used herein, a "synergistically" refers to a greater-than-additive therapeutic effect, which is produced by a combination of at least two agents, and which exceeds that which would otherwise result from the individual administration of the agents. For example, lower doses of one or more agents may be used in treating a disease or disorder, resulting in increased therapeutic efficacy and decreased side-effects. In such embodiments, the FAP binding agent and the additional therapeutic agent may be administered at doses that are lower than the doses employed when the agents are used in the context of monotherapy.

In some embodiments, the present technology pertains to chemotherapeutic agents as additional therapeutic agents. For example, without limitation, such combination of the present FAP binding agents and chemotherapeutic agent find use in the treatment of cancers, as described elsewhere herein. Examples of chemotherapeutic agents include, but are not limited to, alkylating agents such as thiotepa and CYTOXAN cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and trimethylolomelamine; acetogenins (e.g., bullatacin and bullatacinone); a camptothecin (including the synthetic analogue topotecan); bryostatin; cally statin; CC-1065 (including its adozelesin, carzelesin and bizelesin synthetic analogues); cryptophycins (e.g., cryptophycin 1 and cryptophycin 8); dolastatin; duocarmycin (including the synthetic analogues, KW-2189 and CB 1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimnustine; antibiotics such as the enediyne antibiotics (e.g., calicheamicin, especially calicheamicin gammall and calicheamicin omegall (see, e.g., Agnew, Chem. Intl. Ed. Engl., 33: 183-186 (1994)); dynemicin, including dynemicin A; bisphosphonates, such as clodronate; an esperamicin; as well as neocarzinostatin chromophore and related chromoprotein enediyne antibiotic chromophores), aclacinomysins, actinomycin, authramycin, azaserine, bleomycins, cactinomycin, carabicin, caminomycin, carzinophilin, chromomycinis, dactinomycin, daunorubicin, detorubicin, 6-diazo-5-oxo-L-norleucine, ADRIAMYCIN doxorubicin (including morpholino-doxorubicin, cyanomorpholino-doxorubicin, 2-pyrrolino-doxorubicin and deoxy doxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as minoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; demecolcine; diaziquone; elformithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (e.g., T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; toxoids (e.g., TAXOL, paclitaxel (Bristol-Myers Squibb Oncology, Princeton, N.J.), ABRAXANE®, Cremophor-free, albumin-engineered nanoparticle formulation of paclitaxel (American Pharmaceutical Partners, Schaumberg, 111.), and TAXOTERE doxetaxel (Rhone-Poulenc Rorer, Antony, France)); chloranbucil; GEMZAR (gemcitabine); 6-thioguanine; mercaptopurine; methotrexate; platinum analogs (such as, e.g., cisplatin, oxaliplatin and carboplatin); vinblastine; platinum; etoposide (VP-16); ifosfamide; mitoxantrone; vincristine; NAVELBINE (vinorelbine); novantrone; teniposide; edatrexate; daunomycin; aminopterin; xeloda; ibandronate; irinotecan (Camptosar, CPT-11) (including the treatment regimen of irinotecan with 5-FU and leucovorin); topoisomerase inhibitor RFS 2000; difluoromethylornithine (DMFO); retinoids such as retinoic acid; capecitabine; combretastatin; leucovorin (LV); oxaliplatin, including the oxaliplatin treatment regimen (FOLFOX); lapatinib (Tykerb); inhibitors of PKC-a, Raf, H-Ras, EGFR (e.g., erlotinib (Tarceva®)) and VEGF-A that reduce cell proliferation and pharmaceutically acceptable salts, acids or derivatives of any of the above. In addition, in some embodiments, the methods of treatment further include the use of radiation. In addition, in some embodiments, the methods of treatment further include the use of photodynamic therapy.

Accordingly, in some embodiments, the present technology relates to combination therapies using the FAP binding agent and a chemotherapeutic agent. In some embodiments, the present technology relates to administration of the FAP binding agent to a patient undergoing treatment with a chemotherapeutic agent. In some embodiments, the chemotherapeutic agent is a DNA-intercalating agent, such as, without limitation, doxorubicin, cisplatin, daunorubicin, and epirubicin. In some embodiments, the DNA-intercalating agent is doxorubicin.

In some embodiments, the FAP binding agent acts synergistically when co-administered with doxorubicin. In some embodiments, the FAP binding agent acts synergistically when co-administered with doxorubicin for use in treating tumor or cancer. For example, co-administration of the FAP binding agent and doxorubicin may act synergistically to reduce or eliminate the tumor or cancer, or slow the growth and/or progression and/or metastasis of the tumor or cancer. In some embodiments, the combination of the FAP binding agent and doxorubicin may exhibit improved safety profiles when compared to the agents used alone in the context of monotherapy. In some embodiments, the FAP binding agent and doxorubicin are administered at doses that are lower than the doses employed when the agents are used in the context of monotherapy. In some embodiments, the FAP binding agent comprises a mutated interferon such as a mutated IFNα. In some embodiments, the mutated IFNα comprises one or more mutations at positions 148, 149, and 153 with reference to SEQ ID NO: 688 or SEQ ID NO: 689, such as the substitutions M148A, R149A, and L153A.

In some embodiments, the present technology relates to combination therapy with one or more immune-modulating agents, for example, without limitation, agents that modulate immune checkpoint. In some embodiments, the immune-modulating agent targets one or more of PD-1, PD-L1, and PD-L2. In some embodiments, the immune-modulating agent is PD-1 inhibitor. In some embodiments, the immune-modulating agent is an antibody specific for one or more of PD-1, PD-L1, and PD-L2. For instance, in some embodiments, the immune-modulating agent is an antibody such as, by way of non-limitation, nivolumab, (ONO-4538/BMS-936558, MDX1106, OPDIVO, BRISTOL MYERS SQUIBB), pembrolizumab (KEYTRUDA, MERCK), pidilizumab (CT-011, CURE TECH), MK-3475 (MERCK), BMS 936559 (BRISTOL MYERS SQUIBB), MPDL3280A (ROCHE). In some embodiments, the immune-modulating agent targets one or more of CD137 or CD137L. In some embodiments, the immune-modulating agent is an antibody specific for one or more of CD137 or CD137L. For instance, in some embodiments, the immune-modulating agent is an antibody such as, by way of non-limitation, urelumab (also known as BMS-663513 and anti-4-1BB antibody). In some embodiments, the present chimeric protein or Fc-based chimeric protein complex is combined with urelumab (optionally with one or more of nivolumab, lirilumab, and urelumab) for the treatment of solid tumors and/or B-cell non-Hodgkins lymphoma and/or head and neck cancer and/or multiple myeloma. In some embodiments, the immune-modulating agent is an agent that targets one or more of CTLA-4, AP2M1, CD80, CD86, SHP-2, and PPP2R5A. In some embodiments, the immune-modulating agent is an antibody specific for one or more of CTLA-4, AP2M1, CD80, CD86, SHP-2, and PPP2R5A. For instance, in some embodiments, the immune-modulating agent is an antibody such as, by way of non-limitation, ipilimumab (MDX-010, MDX-101, Yervoy, BMS) and/or tremelimumab (Pfizer). In some embodiments, the present chimeric protein or Fc-based chimeric protein complex is combined with ipilimumab (optionally with bavituximab) for the treatment of one or more of melanoma, prostate cancer, and lung cancer. In some embodiments, the immune-modulating agent targets CD20. In some embodiments, the immune-modulating agent is an antibody specific CD20. For instance, in some embodiments, the immune-modulating agent is an antibody such as, by way of non-limitation, Ofatumumab (GENMAB), obinutuzumab (GAZYVA), AME-133v (APPLIED MOLECULAR EVOLUTION), Ocrelizumab (GENENTECH), TRU-015 (TRUBION/EMERGENT), veltuzumab (IMMU-106).

In some embodiments, the present technology relates to combination therapy using the FAP binding agent and a checkpoint inhibitor. In some embodiments, the present technology relates to administration of the FAP binding agent to a patient undergoing treatment with a checkpoint inhibitor. In some embodiments, the checkpoint inhibitor is an agent that targets one or more of PD-1, PD-L1, PD-L2, and CTLA-4 (including any of the anti-PD-1, anti-PD-L1, anti-PD-L2, and anti-CTLA-4 agents described herein). In some embodiment, the checkpoint inhibitor is one or more of nivolumab, (ONO-4538/BMS-936558, MDX1106, OPDIVO, BRISTOL MYERS SQUIBB), pembrolizumab (KEYTRUDA, MERCK), pidilizumab (CT-011, CURE TECH), MK-3475 (MERCK), BMS 936559 (BRISTOL MYERS SQUIBB), MPDL3280A (ROCHE), ipilimumab (MDX-010, MDX-101, Yervoy, BMS) and tremelimumab (Pfizer). In some embodiments, the checkpoint inhibitor is an antibody against PD-L1.

In some embodiments, the FAP binding agent acts synergistically when co-administered with the anti-PD-L1 antibody. In some embodiments, the FAP binding agent acts synergistically when co-administered with the anti-PD-L1 antibody for use in treating tumor or cancer. For example, co-administration of the FAP binding agent and the anti-PD-L1 antibody may act synergistically to reduce or eliminate the tumor or cancer, or slow the growth and/or progression and/or metastasis of the tumor or cancer. In some embodiments, the combination of the FAP binding agent and the anti-PD-L1 antibody may exhibit improved safety profiles when compared to the agents used alone in the context of monotherapy. In some embodiments, the FAP binding agent and the anti-PD-L1 antibody may be administered at doses that are lower than the doses employed when the agents are used in the context of monotherapy. In some embodiments, the FAP binding agent comprises a mutated interferon such as a mutated IFNα. In illustrative embodiments, the mutated IFNα comprises one or more mutations at positions 148, 149, and 153 with reference to SEQ ID NO: 688 or SEQ ID NO: 689, such as the substitutions M148A, R149A, and L153A.

In some embodiments, the present technology relates to combination therapies using the FAP binding agent and an immunosuppressive agent. In some embodiments, the present technology relates to administration of the FAP binding agent to a patient undergoing treatment with an immunosuppressive agent. In some embodiments, the immunosuppressive agent is TNF.

In illustrative embodiments, the FAP binding agent acts synergistically when co-administered with TNF. In an illustrative embodiment, the FAP binding agent acts synergistically when co-administered with TNF for use in treating tumor or cancer. For example, co-administration of the FAP binding agent and TNF may act synergistically to reduce or eliminate the tumor or cancer, or slow the growth and/or progression and/or metastasis of the tumor or cancer. In some embodiments, the combination of the FAP binding agent and TNF may exhibit improved safety profiles when compared to the agents used alone in the context of monotherapy. In some embodiments, the FAP binding agent and TNF may be administered at doses that are lower than the doses employed when the agents are used in the context of monotherapy. In some embodiments, the FAP binding agent comprises a mutated interferon such as a mutated IFNα. In illustrative embodiments, the mutated IFNa comprises one or more mutations at positions 148, 149, and 153 with reference to SEQ ID NO: 688 or SEQ ID NO: 689, such as the substitutions M148A, R149A, and L153A.

In some embodiments, the FAP binding agent acts synergistically when used in combination with Chimeric Antigen Receptor (CAR) T-cell therapy. In an illustrative embodiment, the FAP binding agent acts synergistically when used in combination with CAR T-cell therapy in treating tumor or cancer. In an embodiment, the FAP binding agent acts synergistically when used in combination with CAR T-cell therapy in treating blood-based tumors. In an embodiment, the FAP binding agent acts synergistically when used in combination with CAR T-cell therapy in treating solid tumors. For example, use of the FAP binding agent and CAR T-cells may act synergistically to reduce or eliminate the tumor or cancer, or slow the growth and/or progression and/or metastasis of the tumor or cancer. In some embodiments, the FAP binding agent of the present technology induces CAR T-cell division. In some embodiments, the FAP binding agent of the present technology induces CAR T-cell proliferation. In some embodiments, the FAP binding agent of the present technology prevents anergy of the CAR T cells.

In some embodiments, the CAR T-cell therapy comprises CART cells that target antigens (e.g., tumor antigens) such as, but not limited to, carbonic anhydrase IX (CAIX), 5T4, CD19, CD20, CD22, CD30, CD33, CD38, CD47, CS1, CD138, Lewis-Y, L1-CAM, MUC16, ROR-1, IL13Ra2, gp100, prostate stem cell antigen (PSCA), prostate-specific membrane antigen (PSMA), B-cell maturation antigen (BCMA), human papillomavirus type 16 E6 (HPV-16 E6), CD171, folate receptor alpha (FR-a), GD2, human epidermal growth factor receptor 2 (HER2), mesothelin, EGFRvIII, fibroblast activation protein (FAP), carcinoembryonic antigen (CEA), and vascular endothelial growth factor receptor 2 (VEGF-R2), as well as other tumor antigens well known in the art. Additional illustrative tumor antigens include, but are not limited to MART-1/Melan-A, gp100, Dipeptidyl peptidase IV (DPPIV), adenosine deaminase-binding protein (ADAbp), cyclophilin b, Colorectal associated antigen (CRC)-0017-1A/GA733, Carcinoembryonic Antigen (CEA) and its immunogenic epitopes CAP-1 and CAP-2, etv6, am11, Prostate Specific Antigen (PSA) and its immunogenic epitopes PSA-1, PSA-2, and PSA-3, T-cell receptor/CD3-zeta chain, MAGE-family of tumor antigens (e.g., MAGE-A1, MAGE-A2, MAGE-A3, MAGE-A4, MAGE-A5, MAGE-A6, MAGE-A7, MAGE-A8, MAGE-A9, MAGE-A10, MAGE-A11, MAGE-A12, MAGE-Xp2 (MAGE-B2), MAGE-Xp3 (MAGE-B3), MAGE-Xp4 (MAGE-B4), MAGE-C1, MAGE-C2, MAGE-C3, MAGE-C4, MAGE-05), GAGE-family of tumor antigens (e.g., GAGE-1, GAGE-2, GAGE-3, GAGE-4, GAGE-5, GAGE-6, GAGE-7, GAGE-8, GAGE-9), BAGE, RAGE, LAGE-1, NAG, GnT-V, MUM-1, CDK4, tyrosinase, p53, MUC family, HER2/neu, p21ras, RCAS1, a-fetoprotein, E-cadherin, a-catenin, 3-catenin and y-catenin, p120ctn, gp100 Pme1117, PRAME, NY-ESO-1, cdc27, adenomatous polyposis coli protein (APC), fodrin, Connexin 37, Ig-idiotype, p15, gp75, GM2 and GD2 gangliosides, viral products such as human papilloma virus proteins, Smad family of tumor antigens, Imp-1, NA, EBV-encoded nuclear antigen (EBNA)-1, brain glycogen phosphorylase, SSX-1, SSX-2 (HOM-MEL-40), SSX-1, SSX-4, SSX-5, SCP-1 CT-7, c-erbB-2, CD19, CD37, CD56, CD70, CD74, CD138, AGS16, MUC1, GPNMB, Ep-CAM, PD-L1, and PD-L2.

Illustrative CAR T-cell therapy include, but are not limited to, JCAR014 (Juno Therapeutics), JCAR015 (Juno Therapeutics), JCAR017 (Juno Therapeutics), JCAR018 (Juno Therapeutics), JCAR020 (Juno Therapeutics), JCAR023 (Juno Therapeutics), JCAR024 (Juno Therapeutics), CTL019 (Novartis), KTE-C19 (Kite Pharma), BPX-401 (Bellicum Pharmaceuticals), BPX-501 (Bellicum Pharmaceuticals), BPX-601 (Bellicum Pharmaceuticals), bb2121 (Bluebird Bio), CD-19 Sleeping Beauty cells (Ziopharm Oncology), UCART19 (Cellectis), UCART123 (Cellectis), UCART38 (Cellectis), UCARTCS1 (Cellectis), OXB-302 (Oxford BioMedica, MB-101 (Mustang Bio) and CAR T-cells developed by Innovative Cellular Therapeutics.

In some embodiments, the present technology relates to combination therapy with one or more chimeric agents described in WO 2013/10779, WO 2015/007536, WO 2015/007520, WO 2015/007542, and WO 2015/007903, the entire contents of which are hereby incorporated by reference in their entireties.

In some embodiments, inclusive of, without limitation, infectious disease applications, the present technology pertains to anti-infectives as additional therapeutic agents. In some embodiments, the anti-infective is an anti-viral agent including, but not limited to, Abacavir, Acyclovir, Adefovir, Amprenavir, Atazanavir, Cidofovir, Darunavir, Delavirdine, Didanosine, Docosanol, Efavirenz, Elvitegravir, Emtricitabine, Enfuvirtide, Etravirine, Famciclovir, and Foscarnet. In some embodiments, the anti-infective is an anti-bacterial agent including, but not limited to, cephalosporin antibiotics (cephalexin, cefuroxime, cefadroxil, cefazolin, cephalothin, cefaclor, cefamandole, cefoxitin, cefprozil, and ceftobiprole); fluoroquinolone antibiotics (cipro, Levaquin, floxin, tequin, avelox, and norflox); tetracycline antibiotics (tetracycline, minocycline, oxytetracycline, and doxycycline); penicillin antibiotics (amoxicillin, ampicillin, penicillin V, dicloxacillin, carbenicillin, vancomycin, and methicillin); monobactam antibiotics (aztreonam); and carbapenem antibiotics (ertapenem, doripenem, imipenem/cilastatin, and meropenem). In some embodiments, the anti-infectives include anti-malarial agents (e.g., chloroquine, quinine, mefloquine, primaquine, doxycycline, artemether/lumefantrine, atovaquone/proguanil and sulfadoxine/pyrimethamine), metronidazole, tinidazole, ivermectin, pyrantel pamoate, and albendazole.

In some embodiments, inclusive, without limitation, of autoimmune applications, the additional therapeutic agent is an immunosuppressive agent. In some embodiments, the immunosuppressive agent is an anti-inflammatory agent such as a steroidal anti-inflammatory agent or a non-steroidal anti-inflammatory agent (NSAID). Steroids, particularly the adrenal corticosteroids and their synthetic analogues, are well known in the art. Examples of corticosteroids useful in the present technology include, without limitation, hydroxyltriamcinolone, alpha-methyl dexamethasone, beta-methyl betamethasone, beclomethasone dipropionate, betamethasone benzoate, betamethasone dipropionate, betamethasone valerate, clobetasol valerate, desonide, desoxymethasone, dexamethasone, diflorasone diacetate, diflucortolone valerate, fluadrenolone, fluclorolone acetonide, flumethasone pivalate, fluosinolone acetonide, fluocinonide, flucortine butylester, fluocortolone, fluprednidene (fluprednylidene) acetate, flurandrenolone, halcinonide, hydrocortisone acetate, hydrocortisone butyrate, methylprednisolone, triamcinolone acetonide, cortisone, cortodoxone, flucetonide, fludrocortisone, difluorosone diacetate, fluradrenolone acetonide, medrysone, amcinafel, amcinafide, betamethasone and the balance of its esters, chloroprednisone, clocortelone, clescinolone, dichlorisone, difluprednate, flucloronide, flunisolide, fluoromethalone, fluperolone, fluprednisolone, hydrocortisone, meprednisone, paramethasone, prednisolone, prednisone, beclomethasone dipropionate. (NSAIDS) that may be used in the present technology, include but are not limited to, salicylic acid, acetyl salicylic acid, methyl salicylate, glycol salicylate, salicylmides, benzyl-2,5-diacetoxybenzoic acid, ibuprofen, fulindac, naproxen, ketoprofen, etofenamate, phenylbutazone, and indomethacin. In some embodiments, the immunosupressive agent may be cytostatics such as alkylating agents, antimetabolites (e.g., azathioprine, methotrexate), cytotoxic antibiotics, antibodies (e.g., basiliximab, daclizumab, and muromonab), anti-immunophilins (e.g., cyclosporine, tacrolimus, sirolimus), inteferons, opioids, TNF binding proteins, mycophenolates, and small biological agents (e.g., fingolimod, myriocin). Additional anti-inflammatory agents are described, for example, in U.S. Pat. No. 4,537,776, the entire contents of which is incorporated by reference herein.

In some embodiments, the FAP binding agent described herein, include derivatives that are modified, i.e., by the covalent attachment of any type of molecule to the composition such that covalent attachment does not prevent the activity of the composition. For example, but not by way of limitation, derivatives include composition that have been modified by, inter alia, glycosylation, lipidation, acetylation, pegylation, phosphorylation, amidation, derivatization by known protecting/blocking groups, proteolytic cleavage, linkage to a cellular ligand or other protein, etc. Any of numerous chemical modifications can be carried out by known techniques, including, but not limited to specific chemical cleavage, acetylation, formylation, metabolic synthesis of tunicamycin, etc.

In still other embodiments, the FAP binding agent described herein further comprise a cytotoxic agent, comprising, in illustrative embodiments, a toxin, a chemotherapeutic agent, a radioisotope, and an agent that causes apoptosis or cell death. Such agents may be conjugated to a composition described herein.

The FAP binding agent described herein may thus be modified post-translationally to add effector moieties such as chemical linkers, detectable moieties such as for example fluorescent dyes, enzymes, substrates, bioluminescent materials, radioactive materials, and chemiluminescent moieties, or functional moieties such as for example streptavidin, avidin, biotin, a cytotoxin, a cytotoxic agent, and radioactive materials.

Illustrative cytotoxic agents include, but are not limited to, methotrexate, aminopterin, 6-mercaptopurine, 6-thioguanine, cytarabine, 5-fluorouracil decarbazine; alkylating agents such as mechlorethamine, thioepa chlorambucil, melphalan, carmustine (BSNU), mitomycin C, lomustine (CCNU), 1-methylnitrosourea, cyclothosphamide, mechlorethamine, busulfan, dibromomannitol, streptozotocin, mitomycin C, cis-dichlorodiamine platinum (II) (DDP) cisplatin and carboplatin (paraplatin); anthracyclines include daunorubicin (formerly daunomycin), doxorubicin (adriamycin), detorubicin, carminomycin, idarubicin, epirubicin, mitoxantrone and bisantrene; antibiotics include dactinomycin (actinomycin D), bleomycin, calicheamicin, mithramycin, and anthramycin (AMC); and antimytotic agents such as the vinca alkaloids, vincristine and vinblastine. Other cytotoxic agents include paclitaxel (taxol), ricin, pseudomonas exotoxin, gemcitabine, cytochalasin B, gramicidin D, ethidium bromide, emetine, etoposide, tenoposide, colchicin, dihydroxy anthracin dione, 1-dehydrotestosterone, glucocorticoids, procaine, tetracaine, lidocaine, propranolol, puromycin, procarbazine, hydroxyurea, asparaginase, corticosteroids, mytotane (O, P'-(DDD)), interferons, and mixtures of these cytotoxic agents.

Further cytotoxic agents include, but are not limited to, chemotherapeutic agents such as carboplatin, cisplatin, paclitaxel, gemcitabine, calicheamicin, doxorubicin, 5-fluorouracil, mitomycin C, actinomycin D, cyclophosphamide, vincristine, bleomycin, VEGF antagonists, EGFR antagonists, platins, taxols, irinotecan, 5-fluorouracil, gemcytabine, leucovorine, steroids, cyclophosphamide, melphalan, vinca alkaloids (e.g., vinblastine, vincristine, vindesine and vinorelbine), mustines, tyrosine kinase inhibitors, radiotherapy, sex hormone antagonists, selective androgen receptor modulators, selective estrogen receptor modulators, PDGF antagonists, TNF antagonists, IL-1 antagonists, interleukins (e.g. IL-12 or IL-2), IL-12R antagonists, Toxin conjugated monoclonal antibodies, tumor antigen specific monoclonal antibodies, Erbitux, Avastin, Pertuzumab, anti-CD20 antibodies, Rituxan, ocrelizumab, ofatumumab, DXL625, HERCEPTIN®, or any combination thereof. Toxic enzymes from plants and bacteria such as ricin, diphtheria toxin and Pseudomonas toxin may be conjugated to the therapeutic agents (e.g. antibodies) to generate cell-type-specific-killing reagents (Youle, et al., Proc. Nat'l Acad. Sci. USA 77:5483 (1980); Gilliland, et al., Proc. Nat'l Acad. Sci. USA 77:4539 (1980); Krolick, et al., Proc. Nat'l Acad. Sci. USA 77:5419 (1980)).

Other cytotoxic agents include cytotoxic ribonucleases as described by Goldenberg in U.S. Pat. No. 6,653,104. Embodiments of the present technology also relate to radio-immunoconjugates where a radionuclide that emits alpha or beta particles is stably coupled to the FAP binding agent, with or without the use of a complex-forming agent. Such radionuclides include beta-emitters such as Phosphorus-32, Scandium-47, Copper-67, Gallium-67, Yttrium-88, Yttrium-90, Iodine-125, Iodine-131, Samarium-153, Lutetium-177, Rhenium-186 or Rhenium-188, and alpha-emitters such as Astatine-211, Lead-212, Bismuth-212, Bismuth-213 or Actinium-225.

Illustrative detectable moieties further include, but are not limited to, horseradish peroxidase, acetylcholinesterase, alkaline phosphatase, beta-galactosidase and luciferase. Further illustrative fluorescent materials include, but are not limited to, rhodamine, fluorescein, fluorescein isothiocyanate, umbelliferone, dichlorotriazinylamine, phycoerythrin and dansyl chloride. Further illustrative chemiluminescent moieties include, but are not limited to, luminol. Further illustrative bioluminescent materials include, but are not limited to, luciferin and aequorin. Further illustrative radioactive materials include, but are not limited to, Iodine-125, Carbon-14, Sulfur-35, Tritium and Phosphorus-32.

Methods of Treatment

Methods and compositions described herein have application to treating various diseases and disorders, including, but not limited to cancer, infections, immune disorders, fibrotic diseases, inflammatory diseases or conditions, anemia, autoimmune diseases, cardiovascular diseases, wound healing, ischemia-related diseases, neurodegenerative diseases, metabolic diseases and many other diseases and disorders.

Further, any of the present agents may be for use in the treating, or the manufacture of a medicament for treating, various diseases and disorders, including, but not limited to cancer, infections, immune disorders, inflammatory diseases or conditions, fibrotic diseases, and autoimmune diseases.

In some embodiments, the present invention relates to the treatment of, or a patient having one or more of chronic granulomatous disease, osteopetrosis, idiopathic pulmonary fibrosis, Friedreich's ataxia, atopic dermatitis, Chagas disease, cancer, heart failure, autoimmune disease, sickle cell disease, thalassemia, blood loss, transfusion reaction, diabetes, vitamin B12 deficiency, collagen vascular disease, Shwachman syndrome, thrombocytopenic purpura, Celiac disease, endocrine deficiency state such as hypothyroidism or Addison's disease, autoimmune disease such as Crohn's Disease, systemic lupus erythematosis, rheumatoid arthritis or juvenile rheumatoid arthritis, ulcerative colitis immune disorders such as eosinophilic fasciitis, hypoimmunoglobulinemia, or thymoma/thymic carcinoma, graft versus host disease, preleukemia, Nonhematologic syndrome (e.g., Down's, Dubowwitz, Seckel), Felty syndrome, hemolytic uremic syndrome, myelodysplasic syndrome, nocturnal paroxysmal hemoglobinuria, osteomyelofibrosis, pancytopenia, pure red-cell aplasia, Schoenlein-Henoch purpura, malaria, protein starvation, menorrhagia, systemic sclerosis, liver cirrhosis, hypometabolic states, and congestive heart failure.

In some embodiments, the present invention relates to the treatment of, or a patient having one or more of chronic granulomatous disease, osteopetrosis, idiopathic pulmonary fibrosis, Friedreich's ataxia, atopic dermatitis, Chagas disease, mycobacterial infections, cancer, scleroderma, hepatitis, hepatitis C, septic shock, and rheumatoid arthritis.

In some embodiments, the present technology relates to the treatment of, or a patient having cancer. As used herein, cancer refers to any uncontrolled growth of cells that may interfere with the normal functioning of the bodily organs and systems, and includes both primary and metastatic tumors. Primary tumors or cancers that migrate from their original location and seed vital organs can eventually lead to the death of the subject through the functional deterioration of the affected organs. A metastasis is a cancer cell or group of cancer cells, distinct from the primary tumor location, resulting from the dissemination of cancer cells from the primary tumor to other parts of the body. Metastases may eventually result in death of a subject. For example, cancers can include benign and malignant cancers, polyps, hyperplasia, as well as dormant tumors or micrometastases.

Illustrative cancers that may be treated include, but are not limited to, leukemias (including, for example, acute myeloid, acute lymphoblastic, chronic myeloid, chronic lymphocytic, and hairy cell), lymphomas and myelomas (including, for example, Hodgkin and non-Hodgkin lymphomas, light chain, non-secretory, MGUS, and plasmacytomas), and central nervous system cancers (including, for example, brain (e.g., gliomas (e.g., astrocytoma, oligodendroglioma, and ependymoma), meningioma, pituitary adenoma, and neuromas, and spinal cord tumors (e.g., meningiomas and neurofibroma).

Illustrative cancers that may be treated include, but are not limited to, basal cell carcinoma, biliary tract cancer; bladder cancer; bone cancer; brain and central nervous system cancer; breast cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma; hepatic carcinoma; hepatoma; intraepithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); melanoma; myeloma; neuroblastoma; oral cavity cancer (lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; lymphoma including Hodgkin's and non-Hodgkin's lymphoma, as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia; chronic lymphocytic leukemia (CLL); acute lymphoblastic leukemia (ALL); acute myeloid leukemia (AML); Hairy cell leukemia; chronic myeloblastic leukemia; as well as other carcinomas and sarcomas; and post-transplant lymphoproliferative disorder (PTLD), as well as abnormal vascular proliferation associated with phakomatoses, edema (e.g. that associated with brain tumors), and Meigs' syndrome.

In some embodiments, the present technology provides FAP binding agents that are part of a chimera or Fc-based chimeric protein complex that further comprises modified signaling agents for the treatment of cancer. In some embodiments, the FAP binding agents of the present technology significantly reduce and/or eliminate tumors. In some embodiments, the present FAP binding agents significant reduce and/or eliminate tumors when administered to a subject in combination with other anti-cancer agents such as chemotherapeutic agents, checkpoint inhibitors, and immunosuppressive agents. In some embodiments, the combination of FAP binding agents and other anti-cancer agents synergistically reduced tumor size and/or eliminated tumor cells.

In some embodiments, the present technology relates to cancer combination therapies with a FAP binding agent that is part of a chimera or Fc-based chimeric protein complex comprising one or more targeting moieties and one or more modified signaling agents. Accordingly, the present technology provides for chimeric or fusion proteins or Fc-based chimeric protein complexes that include, for example, a targeting moiety against FAP and one or more signaling agents and uses thereof in combination with anti-cancer agents.

For instance, in some embodiments, the present technology pertains to combination therapies for cancer involving chimeras or Fc-based chimeric protein complexes of a FAP binding agent described herein and a modified signaling agent, including, without limitation a mutated human interferon, such as IFN alpha, including human interferon alpha 2.

In other embodiments, the present FAP binding agent is part of a chimera or Fc-based chimeric protein complex that comprises multiple targeting moieties and therefore be present in bispecific or trispecific formats. For instance, in some embodiments, the present technology pertains to combination therapies for cancer involving chimeras or Fc-based chimeric protein complex of a FAP binding agent and a checkpoint inhibitor binding agent (e.g. anti-PD-L1, anti-PD-1, anti-PD-L2, or anti-CTLA) described herein and a modified signaling agent, including, without limitation a mutated human interferon, such as IFN alpha, including human interferon alpha 2.

In some embodiments, the signaling agent is modified to have reduced affinity or activity for one or more of its receptors, which allows for attenuation of activity (inclusive of agonism or antagonism) and/or prevents non-specific signaling or undesirable sequestration of the chimeric protein or Fc-based chimeric protein complex. In some embodiments, the reduced affinity or activity at the receptor is restorable by attachment with one or more of the targeting moieties described herein or upon inclusion in the Fc-based chimeric protein complex as disclosed herein.

In some embodiments, the present technology relates to the treatment of, or a patient having a microbial infection and/or chronic infection. Illustrative infections include, but are not limited to, HIV/AIDS, tuberculosis, osteomyelitis, hepatitis B, hepatitis C, Epstein-Barr virus or parvovirus, T cell leukemia virus, bacterial overgrowth syndrome, fungal or parasitic infections.

In some embodiments, the present compositions are used to treat or prevent one or more inflammatory diseases or conditions, such as inflammation, acute inflammation, chronic inflammation, respiratory disease, atherosclerosis, restenosis, asthma, allergic rhinitis, atopic dermatitis, septic shock, rheumatoid arthritis, inflammatory bowel disease, inflammatory pelvic disease, pain, ocular inflammatory disease, celiac disease, Leigh Syndrome, Glycerol Kinase Deficiency, Familial eosinophilia (FE), autosomal recessive spastic ataxia, laryngeal inflammatory disease; Tuberculosis, Chronic cholecystitis, Bronchiectasis, Silicosis and other pneumoconioses.

In some embodiments, the present technology has application to treating autoimmune and/or neurodegenerative diseases.

In some embodiments, the present compositions are used to treat or prevent one or more conditions characterized by undesirable CTL activity, and/or conditions characterized by high levels of cell death. For instance, in some embodiments, the present compositions are used to treat or prevent one or more conditions associated with uncontrolled or overactive immune response.

In some embodiments, the present compositions are used to treat or prevent one or more autoimmune and/or neurodegenerative diseases or conditions, such as MS, diabetes mellitus, lupus, celiac disease, Crohn's disease, ulcerative colitis, Guillain-Barre syndrome, scleroderms, Goodpasture's syndrome, Wegener's granulomatosis, autoimmune epilepsy, Rasmussen's encephalitis, Primary biliary sclerosis, Sclerosing cholangitis, Autoimmune hepatitis, Addison's disease, Hashimoto's thyroiditis, Fibromyalgia, Menier's syndrome; transplantation rejection (e.g., prevention of allograft rejection) pernicious anemia, rheumatoid arthritis, systemic lupus erythematosus, dermatomyositis, Sjogren's syndrome, lupus erythematosus, myasthenia gravis, Reiter's syndrome, Grave's disease, and other autoimmune diseases.

In some embodiments, the present technology is used to treat or prevent various autoimmune and/or neurodegenerative diseases. In some embodiments, the autoimmune and/or neurodegenerative diseases selected from MS, Alzheimer's disease (including, without limitation, Early-onset Alzheimer's, Late-onset Alzheimer's, and Familial Alzheimer's disease (FAD), Parkinson's disease and parkinsonism (including, without limitation, Idiopathic Parkinson's disease, Vascular parkinsonism, Drug-induced parkinsonism, Dementia with Lewy bodies, Inherited Parkinson's, Juvenile Parkinson's), Huntington's disease, Amyotrophic lateral sclerosis (ALS, including, without limitation, Sporadic ALS, Familial ALS, Western Pacific ALS, Juvenile ALS, Hiramaya Disease).

In an embodiment, the present invention provides methods for the treatment or prevention of one or more liver disorders, selected from viral hepatitis, alcohol hepatitis, autoimmune hepatitis, alcohol liver disease, fatty liver disease, steatosis, steatohepatitis, non-alcohol fatty liver disease, drug-induced liver disease, cirrhosis, fibrosis, liver failure, drug induced liver failure, metabolic syndrome, hepatocellular carcinoma, cholangiocarcinoma, primary biliary cirrhosis (primary biliary cholangitis), bile capillaries, Gilbert's syndrome, jaundice, and any other liver toxicity-associated indication. In some embodiments, the present invention provides methods for the treatment or prevention of liver fibrosis. In some embodiments, the present invention provides methods for the treatment or prevention of primary sclerosing cholangitis (PSC), chronic liver disease, nonalcoholic fatty liver disease (NAFLD), nonalcoholic steatohepatitis (NASH), hepatitis C infection, alcoholic liver disease, liver damage, optionally due to progressive fibrosis and liver fibrosis. In some embodiments, the present invention provides methods for the treatment or prevention of nonalcoholic steatohepatitis (NASH). In some embodiments, the present invention provides methods that reduce or prevent fibrosis. In some embodiments, the present invention provides methods that reduce or prevent cirrhosis. In some embodiments, the present invention provides methods that reduce or prevent hepatocellular carcinoma.

In some embodiments, the present invention provides methods that treat or prevent a fibrotic disease is optionally selected from liver fibrosis, lung fibrosis, primary sclerosing cholangitis (PSC), chronic liver disease, nonalcoholic fatty liver disease (NAFLD), nonalcoholic steatohepatitis (NASH), hepatitis C infection, alcoholic liver disease, liver damage, liver cirrhosis, and myelodysplastic syndrome In various embodiments, the present invention provides methods for the treatment or prevention of cardiovascular disease, such as a disease or condition affecting the heart and vasculature, including but not limited to, coronary heart disease (CHD), cerebrovascular disease (CVD), aortic stenosis, peripheral vascular disease, atherosclerosis, arteriosclerosis, myocardial infarction (heart attack), cerebrovascular diseases (stroke), transient ischemic attacks (TIA), angina (stable and unstable), atrial fibrillation, arrhythmia, valvular disease, and/or congestive heart failure. In various embodiments, the present invention provides methods for the treatment or prevention of cardiovascular disease which involves inflammation.

In various embodiments, the present invention provides methods for the treatment or prevention of one or more respiratory diseases, such as asthma, chronic obstructive pulmonary disease (COPD), bronchiectasis, allergic rhinitis, sinusitis, pulmonary vasoconstriction, inflammation, allergies, impeded respiration, respiratory distress syndrome, cystic fibrosis, pulmonary hypertension, pulmonary vasoconstriction, emphysema, Hantavirus pulmonary syndrome (HPS), Loeffler's syndrome, Goodpasture's syndrome, Pleurisy, pneumonitis, pulmonary edema, pulmonary fibrosis, Sarcoidosis, complications associated with respiratory syncitial virus infection, and other respiratory diseases.

In some embodiments, methods of the present technology are useful in treatment a human subject. In some embodiments, the human is a pediatric human. In other embodiments, the human is an adult human. In other embodiments, the human is a geriatric human. In other embodiments, the human may be referred to as a patient. In some embodiments, the human is a female. In some embodiments, the human is a male.

In certain embodiments, the human has an age in a range of from about 1 to about 18 months old, from about 18 to about 36 months old, from about 1 to about 5 years old, from about 5 to about 10 years old, from about 10 to about 15 years old, from about 15 to about 20 years old, from about 20 to about 25 years old, from about 25 to about 30 years old, from about 30 to about 35 years old, from about 35 to about 40 years old, from about 40 to about 45 years old, from about 45 to about 50 years old, from about 50 to about 55 years old, from about 55 to about 60 years old, from about 60 to about 65 years old, from about 65 to about 70 years old, from about 70 to about 75 years old, from about 75 to about 80 years old, from about 80 to about 85 years old, from about 85 to about 90 years old, from about 90 to about 95 years old or from about 95 to about 100 years old. In some embodiments, the human has an age of more than 30 years old.

Immune Modulation

In some embodiments, the present compositions are capable of, or find use in methods of, immune modulation. For example, in some embodiments, the present methods of treatment may involve the immune modulation described herein. In some embodiments, the immune modulation involves IFN signaling, including modified IFN signaling, in the context of a dendritic cell (DC).

In some embodiments, a multi-specific FAP binding agent is provided. In some embodiments, such multi-specific FAP binding agent of the present technology recognizes and binds to FAP and one or more antigens found on one or more immune cells, which can include, without limitation, megakaryocytes, thrombocytes, erythrocytes, mast cells, basophils, neutrophils, eosinophils, monocytes, macrophages, natural killer cells, T lymphocytes (e.g., cytotoxic T lymphocytes, T helper cells, natural killer T cells), B lymphocytes, plasma cells, dendritic cells, or subsets thereof. In some embodiments, the FAP binding agent specifically binds to an antigen of interest and effectively directly or indirectly recruits one of more immune cells.

In some embodiments, the FAP binding agent specifically binds to an antigen of interest and effectively directly or indirectly recruits one of more immune cells to cause an immunosuppressive effect, e.g. the FAP binding agent directly or indirectly recruits an immunosuppressive immune cell. In some embodiments, the immunosuppressive immune cell is a regulatory T cell (or "Tregs" which, as used herein, refers to a subpopulation of T cells which modulate the immune system, abrogate autoimmune disease, maintain tolerance to self-antigens and thwart anti-tumor immune responses). Other immunosuppressive immune cells include myeloid suppressor cells (or "MSC," which, as used herein, refers to a heterogeneous population of cells, defined by their myeloid origin, immature state, and ability to potently suppress T cell responses); tumor associated neutrophils (or "TANs" which, as used herein, refers to a subset of neutrophils that are capable of suppressing immune responses); tumor associated macrophages (or "TAMs" which, as used herein, refers to a subset of macrophages that may reduce an immune response), M2 macrophages, and/or tumor-inducing mast cells (which as used herein, refers to a subset of bone marrow-derived, long-lived, heterogeneous cellular population). Also, immunosuppressive immune cells include Th2 cells and Th17 cells. Additionally, immunosuppressive immune cells include immune cells, e.g., CD4+ and/or CD8+ T cells, expressing one or more checkpoint inhibitory receptors (e.g. receptors, including CTLA-4, B7-H3, B7-H4, TIM-3, expressed on immune cells that prevent or inhibit uncontrolled immune responses). See Stagg, J. et. al., Immunotherapeutic approach in triple-negative breast cancer. Ther Adv Med Oncol. (2013) 5(3):169-181).

In some embodiments, the FAP binding agent stimulates regulatory T cell (Treg) proliferation. Treg cells are characterized by the expression of the Foxp3 (Forkhead box p3) transcription factor. Most Treg cells are CD4+ and CD25+, and can be regarded as a subset of helper T cells, although a small population may be CD8+. Thus the immune response which is to be modulated by a method of the present technology may comprise inducing proliferation of Treg cells, optionally in response to an antigen. Thus the method may comprise administering to the subject a composition comprising the antigen, wherein the antigen is associated with a binding agent having affinity for FAP. The antigen may be administered with an adjuvant which promotes proliferation of Treg cells.

Insofar as this method involves stimulating proliferation and differentiation of Treg cells in response to a specific antigen, it can be considered to be a method of stimulating an immune response. However, given that Treg cells may be capable of modulating the response of other cells of the immune system against an antigen in other ways, e.g. inhibiting or suppressing their activity, the effect on the immune system as a whole may be to modulate (e.g. suppress or inhibit) the response against that antigen. Thus, the methods of this aspect of the present technology can equally be referred to as methods of modulating (e.g. inhibiting or suppressing) an immune response against an antigen.

In some embodiments, the methods therapeutically or prophylactically inhibit or suppress an undesirable immune response against a particular antigen, even in a subject with pre-existing immunity or an on-going immune response to that antigen. This may be particularly useful, for example, in the treatment of autoimmune disease.

Under certain conditions, it may also be possible to tolerize a subject against a particular antigen by targeting the antigen to an antigen presenting cell expressing FAP. The present technology thus provides a method for inducing tolerance in a subject towards an antigen, comprising administering to the subject a composition comprising the antigen, wherein the antigen is associated with a binding agent having affinity for FAP and wherein the antigen is administered in the absence of an adjuvant. Tolerance in this context typically involves depletion of immune cells which would otherwise be capable of responding to that antigen, or inducing a lasting reduction in responsiveness to an antigen in such immune cells.

It may be particularly desirable to raise a Treg response against an antigen to which the subject exhibits, or is at risk of developing, an undesirable immune response. For example, it may be a self-antigen against which an immune response occurs in an autoimmune disease. Examples of autoimmune diseases in which specific antigens have been identified as potentially pathogenically significant include multiple sclerosis (myelin basic protein), insulin-dependent diabetes mellitus (glutamic acid decarboxylase), insulin-resistant diabetes mellitus (insulin receptor), celiac disease (gliadin), bullous pemphigoid (collagen type XVII), auto-immune haemolytic anaemia (Rh protein), auto-immune thrombocytopenia (GpIIb/IIIa), myaesthenia gravis (acetylcholine receptor), Graves' disease (thyroid-stimulating hormone receptor), glomerulonephritis, such as Goodpasture's disease (alpha3(IV)NC1 collagen), and pernicious anaemia (intrinsic factor). Alternatively, the target antigen may be an exogenous antigen which stimulates a response which also causes damage to host tissues. For example, acute rheumatic fever is caused by an antibody response to a Streptococcal antigen which cross-reacts with a cardiac muscle cell antigen. Thus, these antigens, or particular fragments or epitopes thereof, may be suitable antigens for use in the present technology.

In some embodiments, the present agents, or methods using these agents, disrupt FAP signaling (e.g. via neutralization of FAP), e.g. by reducing or inhibiting FAP binding to its ligand. Some autoimmune diseases are characterized by unusually high levels of cell death and it is believed that immune responses against self antigens associated with these cells may contribute to the pathogenesis of these conditions. FAP antagonists may therefore be used to prevent FAP from binding to the ligand exposed in dead and dying cells (e.g. those undergoing immunogenic cell death) and may thus inhibit or prevent stimulation of immune responses against these antigens.

In some embodiments, the present agents, or methods using these agents, reduce or suppress autoreactive T cells. In some embodiments, the multi-specific FAP binding agent, optionally through an interferon signaling in the context of a chimera or Fc-based chimeric protein complex, causes this immunosuppression. In some embodiments, the multi-specific FAP binding agent stimulates PD-L1 or PD-L2 signaling and/or expression which may suppress autoreactive T cells. In some embodiments, the FAP binding agent, optionally through an interferon signaling in the context of a chimera or Fc-based chimeric protein complex, causes this immunosuppression. In some embodiments, the FAP binding agent stimulates PD-L1 or PD-L2 signaling and/or expression which may suppress autoreactive T cells.

In some embodiments, the present methods comprise modulating the ratio of regulatory T cells to effector T cells in favor of immunosuppression, for instance, to treat autoimmune diseases. For instance, the present methods, in some embodiments, reduce and/or suppress one or more of cytotoxic T cells; effector memory T cells; central memory T cells; CD8+ stem cell memory effector cells; TH1 effector T-cells; TH2 effector T cells; TH9 effector T cells; TH17 effector T cells. For instance, the present methods, in some embodiments, increase and/or stimulate one or more of CD4+CD25+FOXP3+ regulatory T cells, CD4+CD25+ regulatory T cells, CD4+CD25– regulatory T cells, CD4+ CD25high regulatory T cells, TIM-3+PD-1+ regulatory T cells, lymphocyte activation gene-3 (LAG-3)' regulatory T cells, CTLA-4/CD152+ regulatory T cells, neuropilin-1 (Nrp-1)±regulatory T cells, CCR4+CCR8+ regulatory T cells, CD62L (L-selectin)' regulatory T cells, CD45RBlow regulatory T cells, CD127low regulatory T cells, LRRC32/ GARP+ regulatory T cells, CD39+ regulatory T cells, GITR+ regulatory T cells, LAP' regulatory T cells, 1B11+ regulatory T cells, BTLA+ regulatory T cells, type 1 regulatory T cells (Tr1 cells), T helper type 3 (Th3) cells, regulatory cell of natural killer T cell phenotype (NKTregs), CD8+ regulatory T cells, CD8+CD28– regulatory T cells and/or regulatory T-cells secreting IL-10, IL-35, TGF-3, TNF-a, Galectin-1, IFN-y and/or MCP1.

In some embodiments, the present methods favor immune inhibitory signals over immune stimulatory signals. In some embodiments, the present methods allow for reversing or suppressing immune activating or co-stimulatory signals. In some embodiments, the present methods allow for providing immune inhibitory signals. For instance, in some embodiments, the present agents and methods reduce the effects of an immune stimulatory signal, which, without limitation, is one or more of 4-1BB, OX-40, HVEM, GITR, CD27, CD28, CD30, CD40, ICOS ligand; OX-40 ligand, LIGHT (CD258), GITR ligand, CD70, B7-1, B7-2, CD30 ligand, CD40 ligand, ICOS, ICOS ligand, CD137 ligand and TL1A. Further, in some embodiments, the present agents and methods increase the effects of an immune inhibitory signal, which, without limitation, is one or more of CTLA-4, PD-L1, PD-L2, PD-1, BTLA, HVEM, TIM3, GAL9, LAG3, VISTA, KIR, 2B4, CD160 (also referred to as BY55), CGEN-15049, CHK 1 and CHK2 kinases, A2aR, CEACAM (e.g., CEACAM-1, CEACAM-3 and/or CEACAM-5), and various B-7 family ligands (including, but are not limited to, B7-1, B7-2, B7-DC, B7-H1, B7-H2, B7-H3, B7-H4, B7-H5, B7-H6 and B7-H7.

Kits

The present technology also provides kits for the administration of any FAP binding agent described herein (e.g. with or without additional therapeutic agents). The kit is an assemblage of materials or components, including at least one of the inventive pharmaceutical compositions described herein. Thus, in some embodiments, the kit contains at least one of the pharmaceutical compositions described herein.

The exact nature of the components configured in the kit depends on its intended purpose. In one embodiment, the kit is configured for the purpose of treating human subjects.

Instructions for use may be included in the kit. Instructions for use typically include a tangible expression describing the technique to be employed in using the components of the kit to effect a desired therapeutic outcome, such as to treat cancer. Optionally, the kit also contains other useful components, such as, diluents, buffers, pharmaceutically acceptable carriers, syringes, catheters, applicators, pipetting or measuring tools, bandaging materials or other useful paraphernalia as will be readily recognized by those of skill in the art.

The materials and components assembled in the kit can be provided to the practitioner stored in any convenience and suitable ways that preserve their operability and utility. For example, the components can be provided at room, refrigerated or frozen temperatures. The components are typically contained in suitable packaging materials. In some embodiments, the packaging material is constructed by well-known methods, preferably to provide a sterile, contaminant-free environment. The packaging material may have an external label which indicates the contents and/or purpose of the kit and/or its components.

Definitions

As used herein, "a," "an," or "the" can mean one or more than one.

Further, the term "about" when used in connection with a referenced numeric indication means the referenced numeric indication plus or minus up to 10% of that referenced numeric indication. For example, the language "about 50" covers the range of 45 to 55.

As used herein, the term "effective amount" refers to a quantity sufficient to achieve a desired therapeutic and/or prophylactic effect, e.g., an amount which results in the prevention of, or a decrease in a disease or disorder or one or more signs or symptoms associated with a disease or disorder. In the context of therapeutic or prophylactic applications, the amount of a composition administered to the subject will depend on the degree, type, and severity of the disease and on the characteristics of the individual, such as general health, age, sex, body weight and tolerance to drugs. The skilled artisan will be able to determine appropriate dosages depending on these and other factors. The compositions can also be administered in combination with one or more additional therapeutic compounds. In the methods described herein, the therapeutic compounds may be administered to a subject having one or more signs or symptoms of a disease or disorder.

As used herein, something is "decreased" if a read-out of activity and/or effect is reduced by a significant amount, such as by at least about 10%, at least about 20%, at least about 30%, at least about 40%, at least about 50%, at least about 60%, at least about 70%, at least about 80%, at least about 90%, at least about 95%, at least about 97%, at least about 98%, or more, up to and including at least about 100%, in the presence of an agent or stimulus relative to the absence of such modulation. As will be understood by one of ordinary skill in the art, in some embodiments, activity is decreased and some downstream read-outs will decrease but others can increase.

Conversely, activity is "increased" if a read-out of activity and/or effect is increased by a significant amount, for example by at least about 10%, at least about 20%, at least about 30%, at least about 40%, at least about 50%, at least about 60%, at least about 70%, at least about 80%, at least about 90%, at least about 95%, at least about 97%, at least about 98%, or more, up to and including at least about 100% or more, at least about 2-fold, at least about 3-fold, at least about 4-fold, at least about 5-fold, at least about 6-fold, at least about 7-fold, at least about 8-fold, at least about 9-fold, at least about 10-fold, at least about 50-fold, at least about 100-fold, in the presence of an agent or stimulus, relative to the absence of such agent or stimulus.

As referred to herein, all compositional percentages are by weight of the total composition, unless otherwise specified. As used herein, the word "include," and its variants, is intended to be non-limiting, such that recitation of items in a list is not to the exclusion of other like items that may also be useful in the compositions and methods of this technology. Similarly, the terms "can" and "may" and their variants are intended to be non-limiting, such that recitation that an embodiment can or may comprise certain elements or features does not exclude other embodiments of the present technology that do not contain those elements or features.

Although the open-ended term "comprising," as a synonym of terms such as including, containing, or having, is used herein to describe and claim the present technology, the present technology, or embodiments thereof, may alternatively be described using alternative terms such as "consisting of" or "consisting essentially of."

As used herein, the words "preferred" and "preferably" refer to embodiments of the technology that afford certain benefits, under certain circumstances. However, other embodiments may also be preferred, under the same or other circumstances. Furthermore, the recitation of one or more preferred embodiments does not imply that other embodiments are not useful, and is not intended to exclude other embodiments from the scope of the technology.

As used herein, a "therapeutically effective amount," or "pharmacologically effective amount," or "pharmacologically effective dose" of a compound refers to compound levels in which the physiological effects of a disease or disorder are, at a minimum, ameliorated. Therapeutic benefit also includes halting or slowing the progression of the underlying disease or disorder, regardless of whether improvement is realized. A therapeutically effective amount can be given in one or more administrations. The amount of a compound which constitutes a therapeutically effective amount will vary depending on the compound, the disorder and its severity, and the general health, age, sex, body weight and tolerance to drugs of the subject to be treated, but can be determined routinely by one of ordinary skill in the art.

Effective amounts, toxicity, and therapeutic efficacy can be determined by standard pharmaceutical procedures in cell cultures or experimental animals, e.g., for determining the LD50 (the dose lethal to about 50% of the population) and the ED50 (the dose therapeutically effective in about 50% of the population). The dosage can vary depending upon the dosage form employed and the route of administration utilized. The dose ratio between toxic and therapeutic effects is the therapeutic index and can be expressed as the ratio LD50/ED50. In some embodiments, compositions and methods that exhibit large therapeutic indices are preferred. A therapeutically effective dose can be estimated initially from in vitro assays, including, for example, cell culture assays. Also, a dose can be formulated in animal models to achieve a circulating plasma concentration range that includes the IC50 as determined in cell culture, or in an appropriate animal model. Levels of the described compositions in plasma can be measured, for example, by high performance liquid chromatography. The effects of any particular dosage can be monitored by a suitable bioassay. The dosage can be determined by a physician and adjusted, as necessary, to suit observed effects of the treatment.

In certain embodiments, the effect will result in a quantifiable change of at least about 10%, at least about 20%, at least about 30%, at least about 50%, at least about 70%, or at least about 90%. In some embodiments, the effect will result in a quantifiable change of about 10%, about 20%, about 30%, about 50%, about 70%, or even about 90% or more. Therapeutic benefit also includes halting or slowing the progression of the underlying disease or disorder, regardless of whether improvement is realized.

As used herein, "methods of treatment" are equally applicable to use of a composition for treating the diseases or disorders described herein and/or compositions for use and/or uses in the manufacture of a medicaments for treating the diseases or disorders described herein.

EXAMPLES

The term Actaferon (AFN) is occasionally used herein to reference a chimeric protein described herein (details are provided in the Examples regarding the format of the chimeric protein).

Example 1. Generation of Human FAP VHH Library

A llama was subcutaneously injected on days 0, 7, 14, 21, 28 and 35, each time with about 200 μg recombinant human FAPα extracellular domain. On day 40, about 100 ml anticoagulated blood was collected from the llama for lymphocyte preparation. A VHH library was constructed from these lymphocytes to screen for the presence of antigen-specific VHHs. The library was panned on solid-phase coated antigen (100 μg/ml in 100 mM NaHCO3 pH 8.2) for 3 rounds. Based on sequence data of the positive colonies, 96 different full length VHHs were distinguished, belonging to 13 different CDR3 groups (see Table 6, SEQ ID Nos: 2-42, 46-86, and 837-850).

TABLE 6

| Group | Member(s) |
|---|---|
| 1 | 2PE2, 2PE5, 2PE7, 2PE13, 2PE14, 2PE17, 2PE19, 2PE20, 2PE23, 2PE25, 2PE27, 2PE28, 2PE29, 2PE30, 2PE32, 2PE33, 2PE36, 2PE38, 2PE39, 2PE40, 2PE41, 2PE42, 2PE43, 2PE44, 2PE47, 2PE49, 2PE55, 2PE56, 2PE58, 2PE59, 2PE60, 2PE61, 2PE62, 2PE63, 2PE67, 2PE68, 2PE71, 2PE72, 2PE76, 2PE83, 2PE84, 2PE86, 2PE87, 2PE88, 2PE95, 3PE1, 3PE5, 3PE12, 3PE21, 3PE28, 3PE42, 3PE43, 3PE44, 3PE47, 3PE49, 3PE57, 3PE62, 3PE69, 3PE72, 3PE77, 3PE82, 3PE90, 3PE92, 3PE93, 3PE94 |
| 2 | 2PE18, 2PE22, 2PE26, 3PE4, 3PE16, 3PE22, 3PE25, 3PE26, 3PE33, 3PE46, 3PE55, 3PE61, 3PE63, 3PE70 |
| 3 | 2PE1, 2PE35, 3PE11 |
| 4 | 2PE48, 3PE60 |
| 5 | 2PE34, 3PE80 |
| 6 | 2PE54, 3PE81 |
| 7 | 2PE10, 3PE66 |
| 8 | 2PE31 |
| 9 | 2PE79 |

TABLE 6-continued

| Group | Member(s) |
|-------|-----------|
| 10 | 2PE91 |
| 11 | 3PE38 |
| 12 | 2PE57 |
| 13 | 3PE15 |

Example 2. Characterisation Human FAP VHHs

Expression-vectors (pMECS) encoding the 96 human FAP binding VHHs from Example 1 were transformed to WK6 cells. VHHs (with a C-terminal His-tag) were expressed in periplasmic extracts upon IPTG overnight stimulation. These extracts were applied in a FACS binding-assay: HEK293T cells were transiently transfected with plasmids encoding human FAP plasmid (pMET7 FLAG-hFAP), mouse FAP (pMET7 FLAG-mFAP) or an empty vector (MOCK) as control. Two days after transfections, cells were resuspended and incubated with a 1 over 5 dilution periplasmic extracts in FACS buffer (PBS+0.5 mM EDTA+3% FBS). VHH binding was detected using a FITC-coupled anti-His Ab (GENSCRIPT). Samples were acquired with a MACSQuant X instrument (MILTENYI BIOTEC) and analyzed using the FlowLogic software (MILTENYI BIOTEC). Data are summarized in FIG. 1.

Figure 2A:
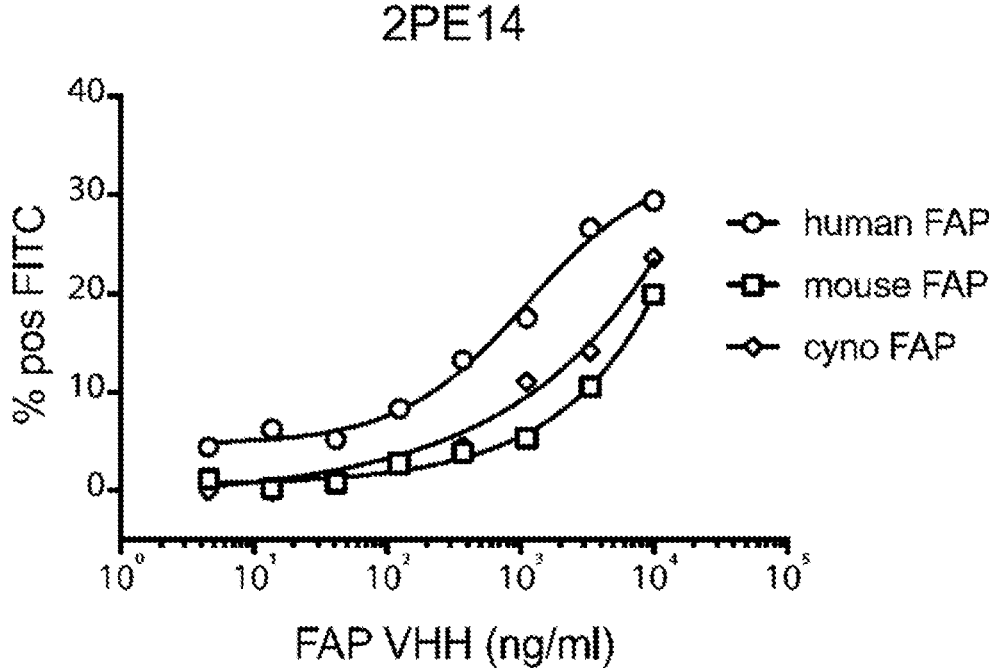
FIGS. 2A-K shows binding selection of VHHs to human, mouse, and cynomolgus monkey FAP in FACS. HEK293T cells transiently transfected with human FAP, mouse FAP or an empty vector (MOCK) were incubated with a serial dilution purified FAP VHH. Binding was measured and plotted as the difference in mean fluorescent intensity (MFI) between FAP and MOCK transfected cells.
Figure 2B:
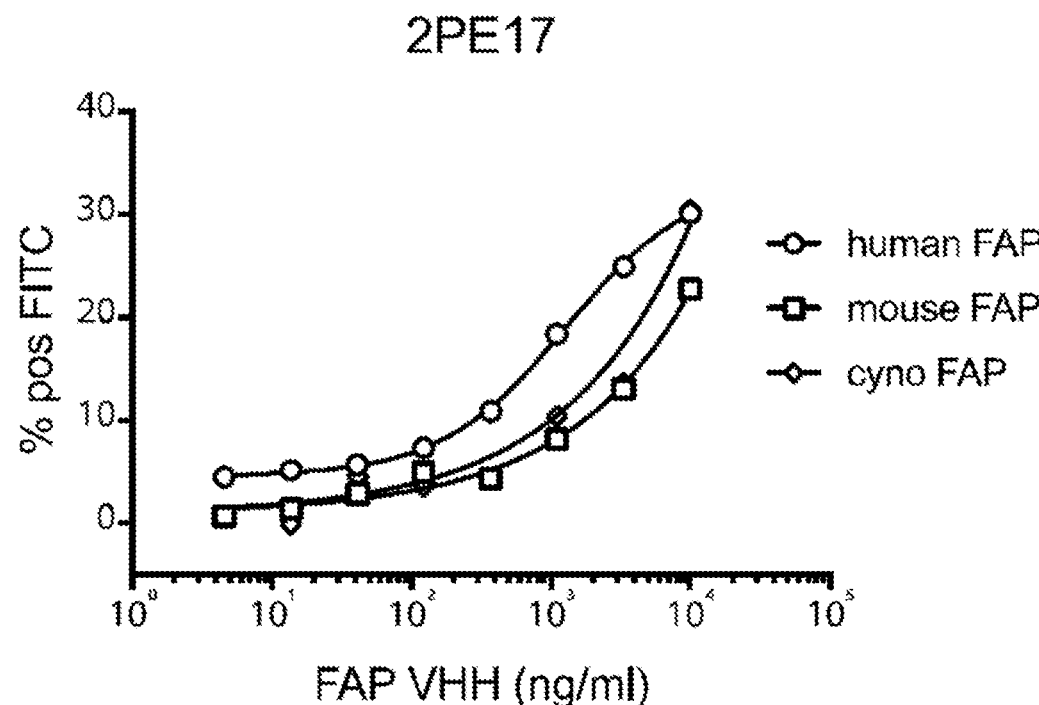
Figure 2C:
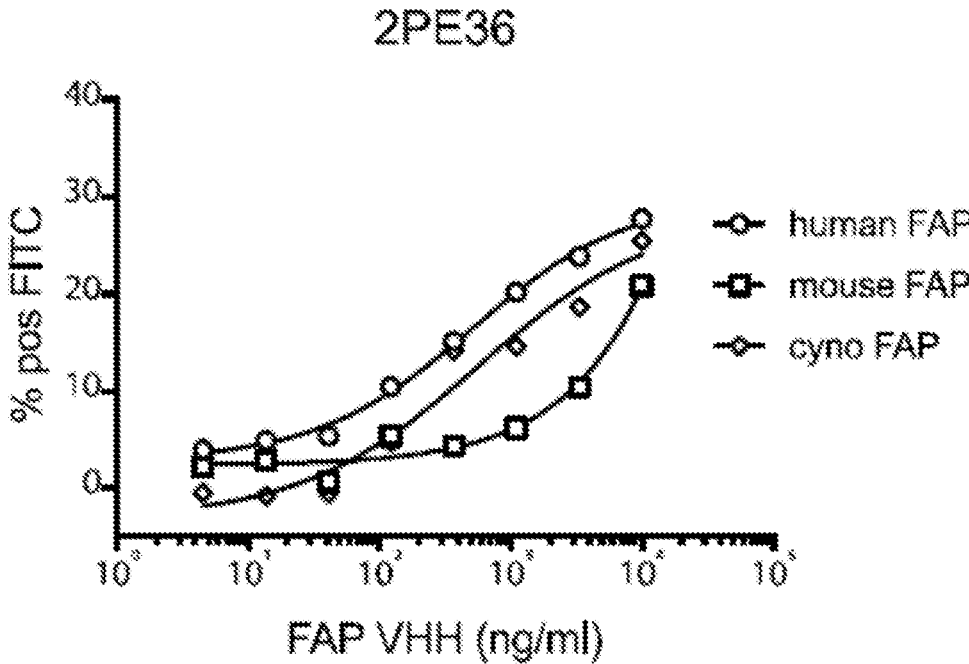
Figure 2D:
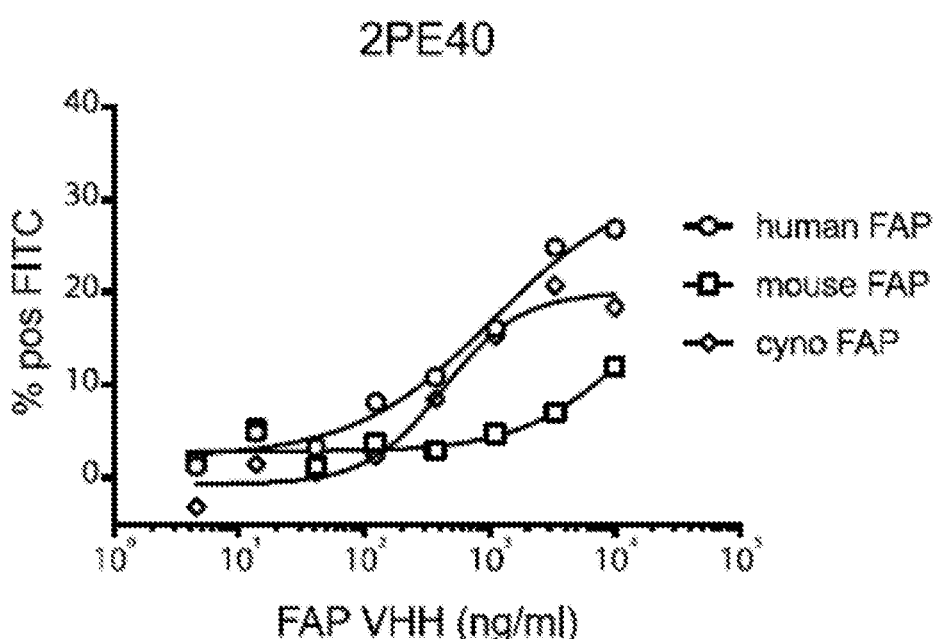
Figure 2E:
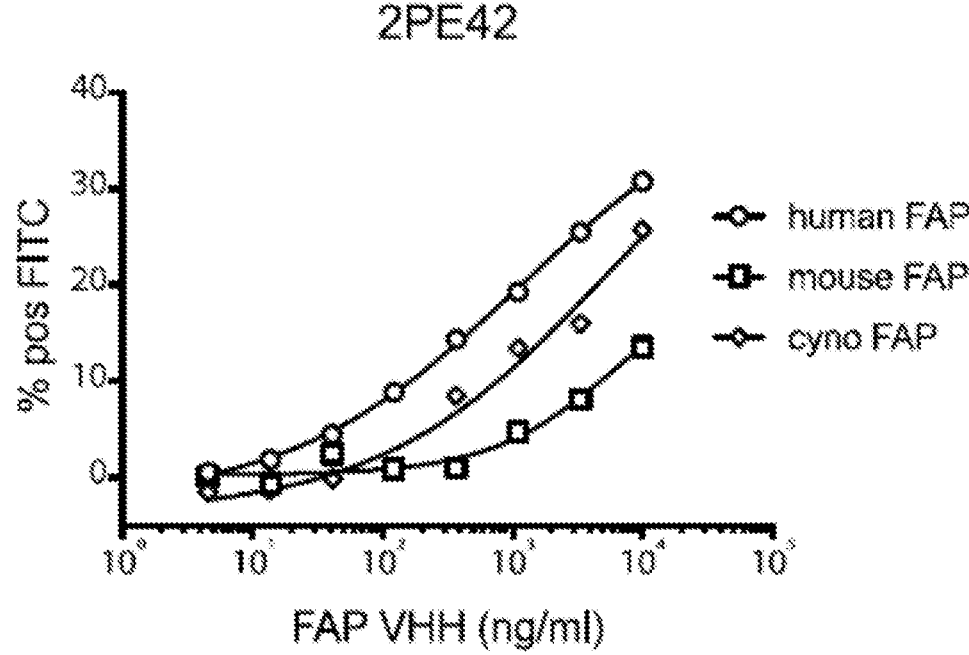
Figure 2F:
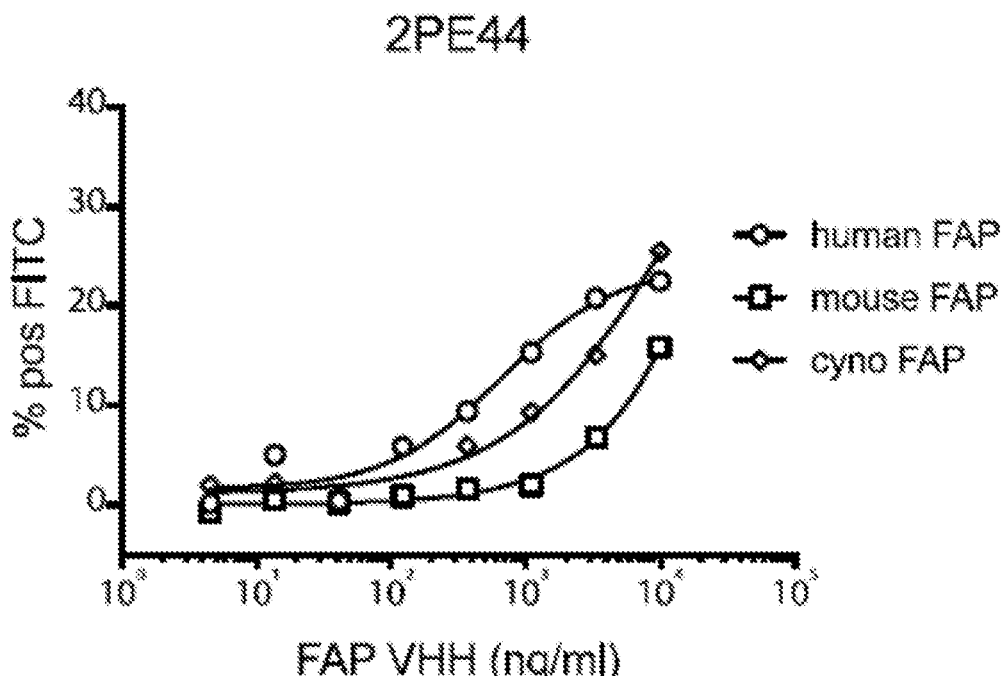
Figure 2G:
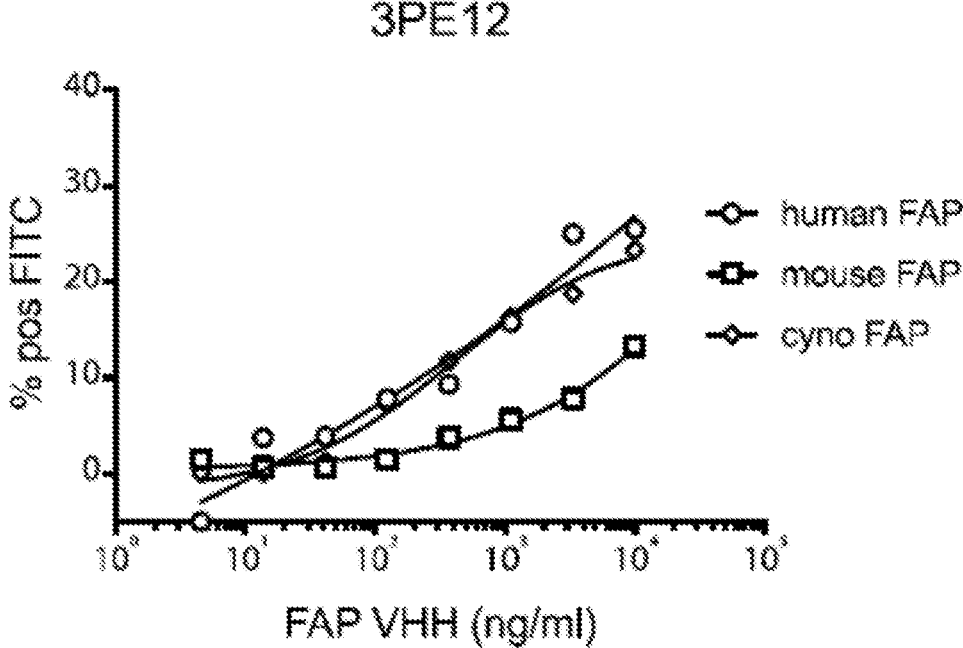
Figure 2H:
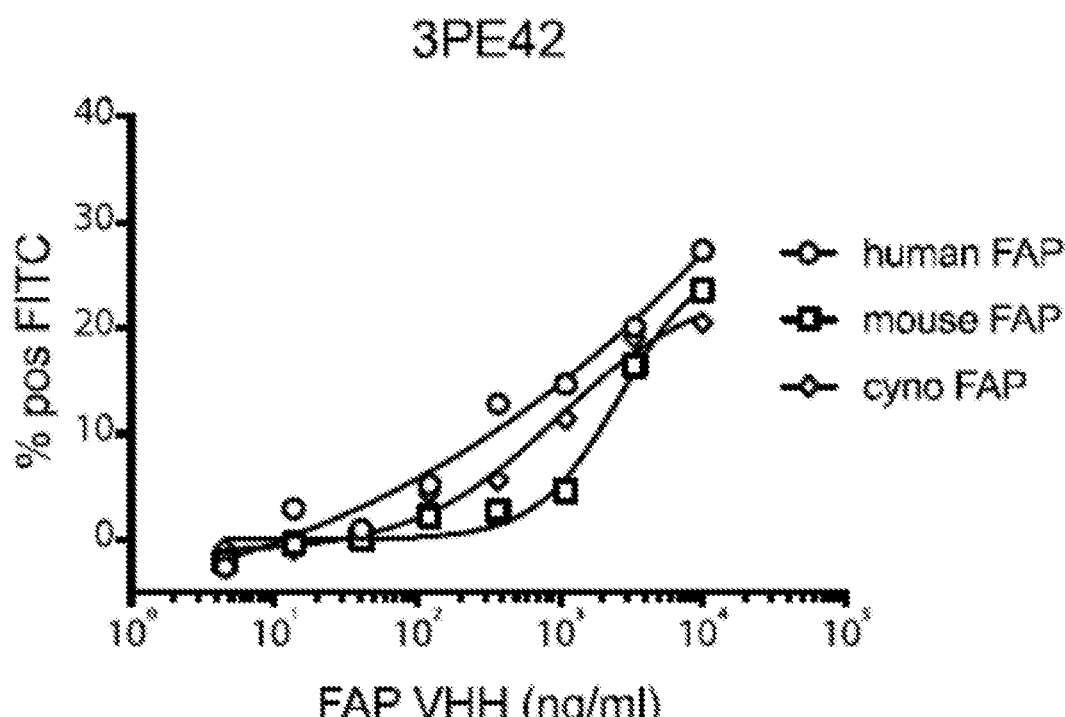
Figure 2I:
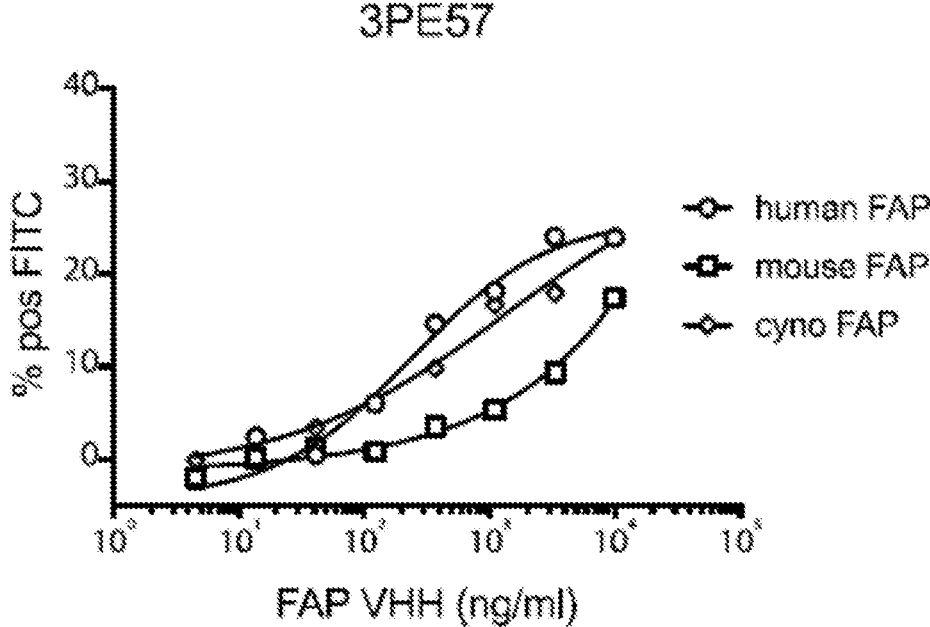
Figure 2J:
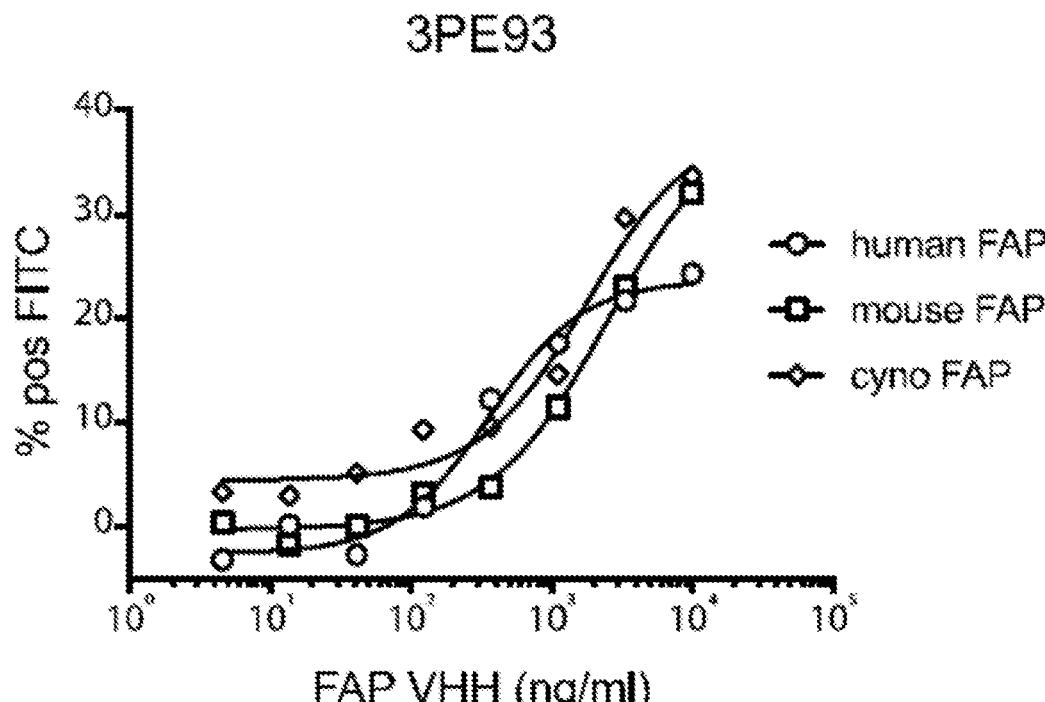
Figure 2K:
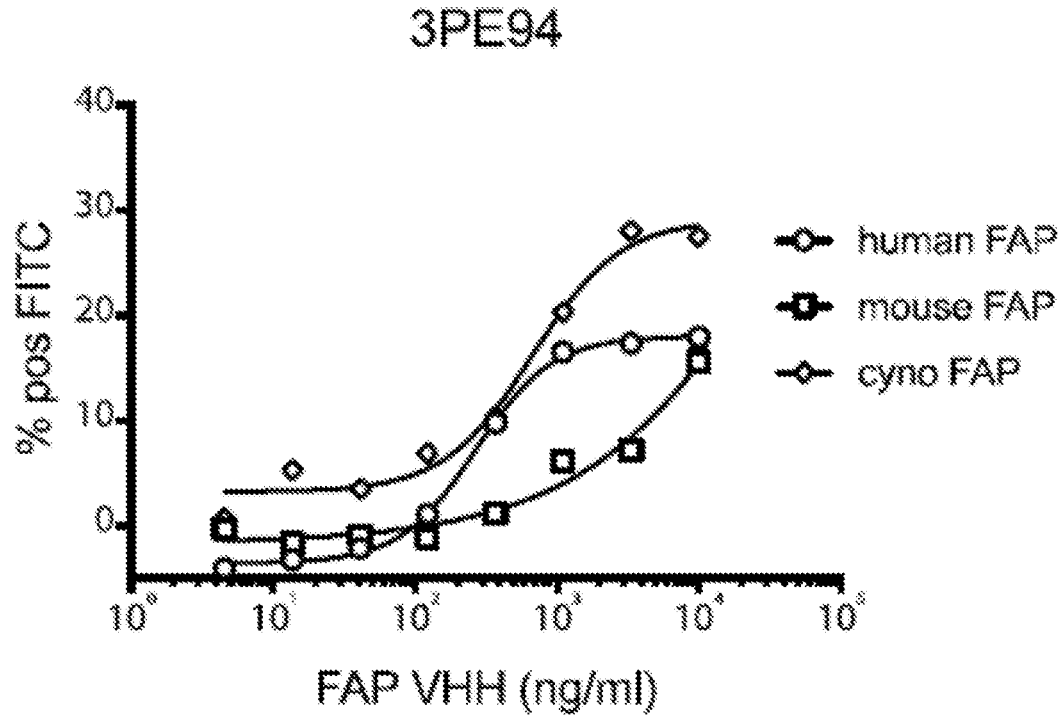
Figure 3A:
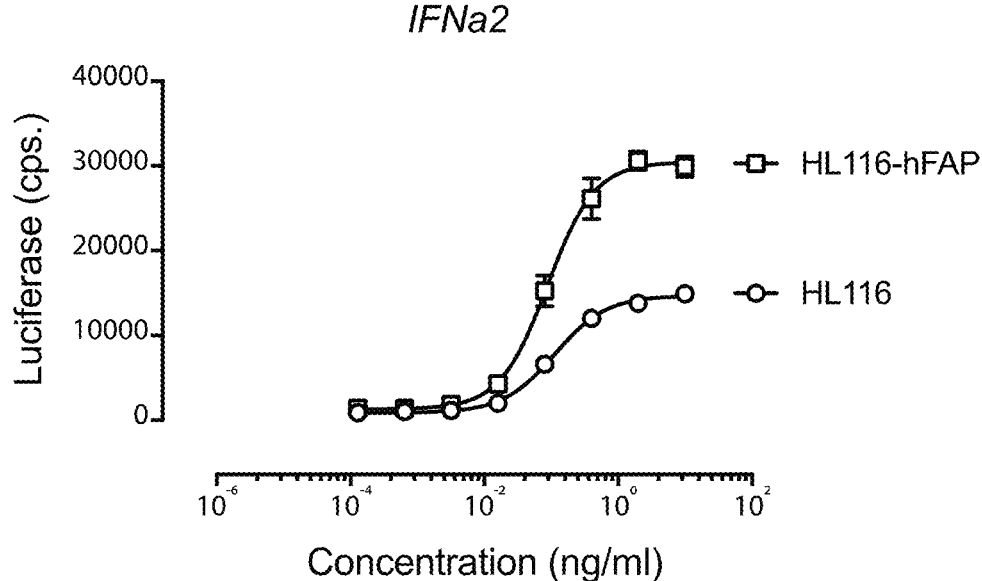
FIGS. 3A-D show wild type IFNα2 and FAP VHH ActaFeron (AFN) signaling in HL116 and HL116-hFAP cells upon targeting. Parental HL116 or the derived HL116- hFAP cells were stimulated with wild type IFNa2 or FAP VHH AFN as indicated for 6 hours. Average luciferase values (±STDEV) of triplicate measurements are plotted.
Figure 3B:
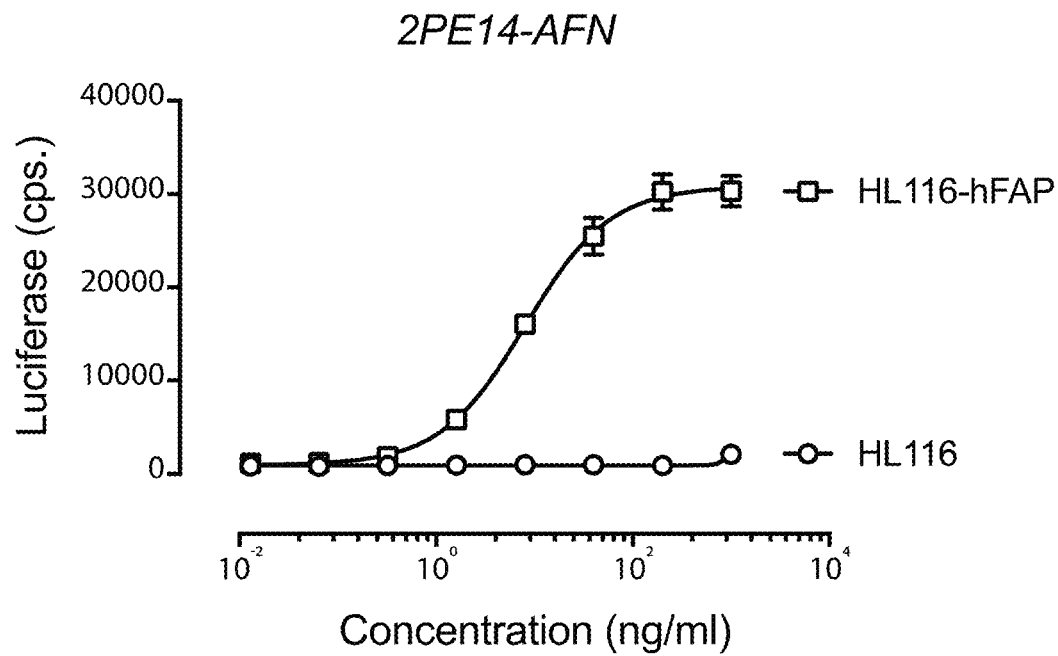
Figure 3C:
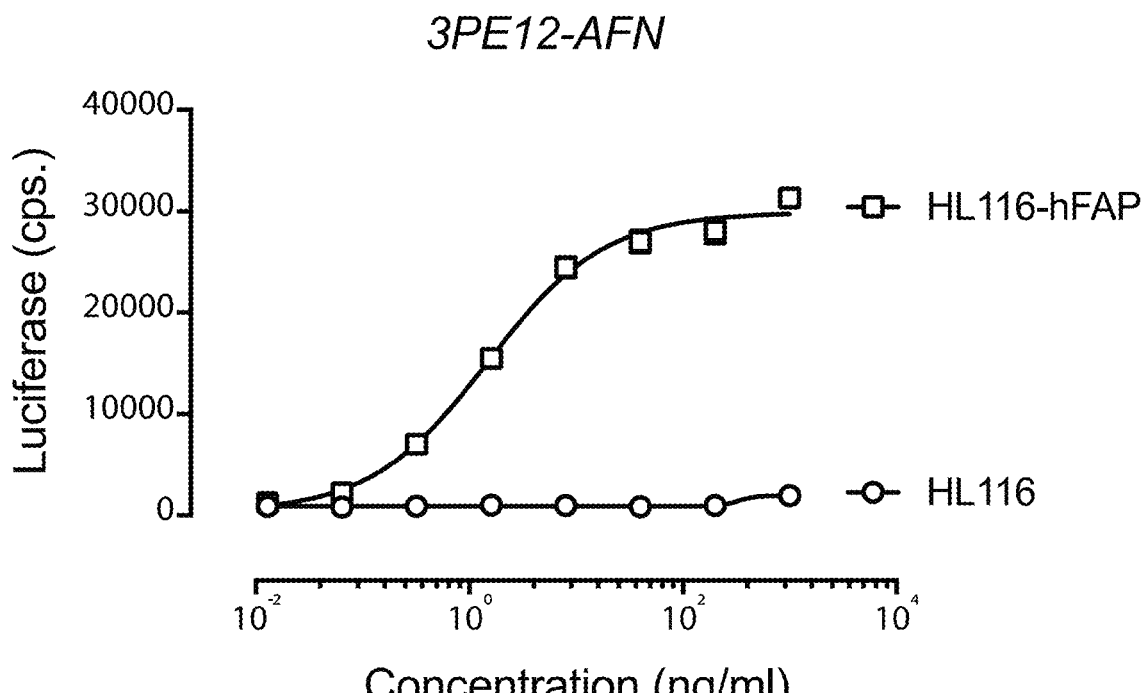
Figure 3D:
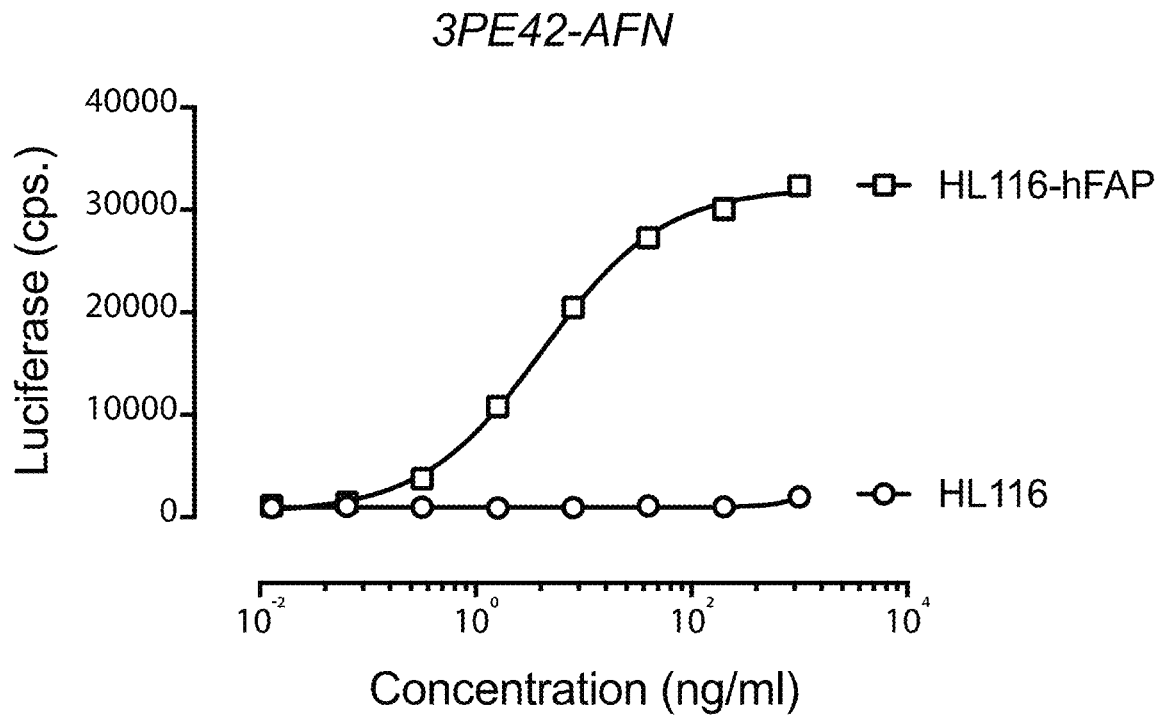
Figure 4:
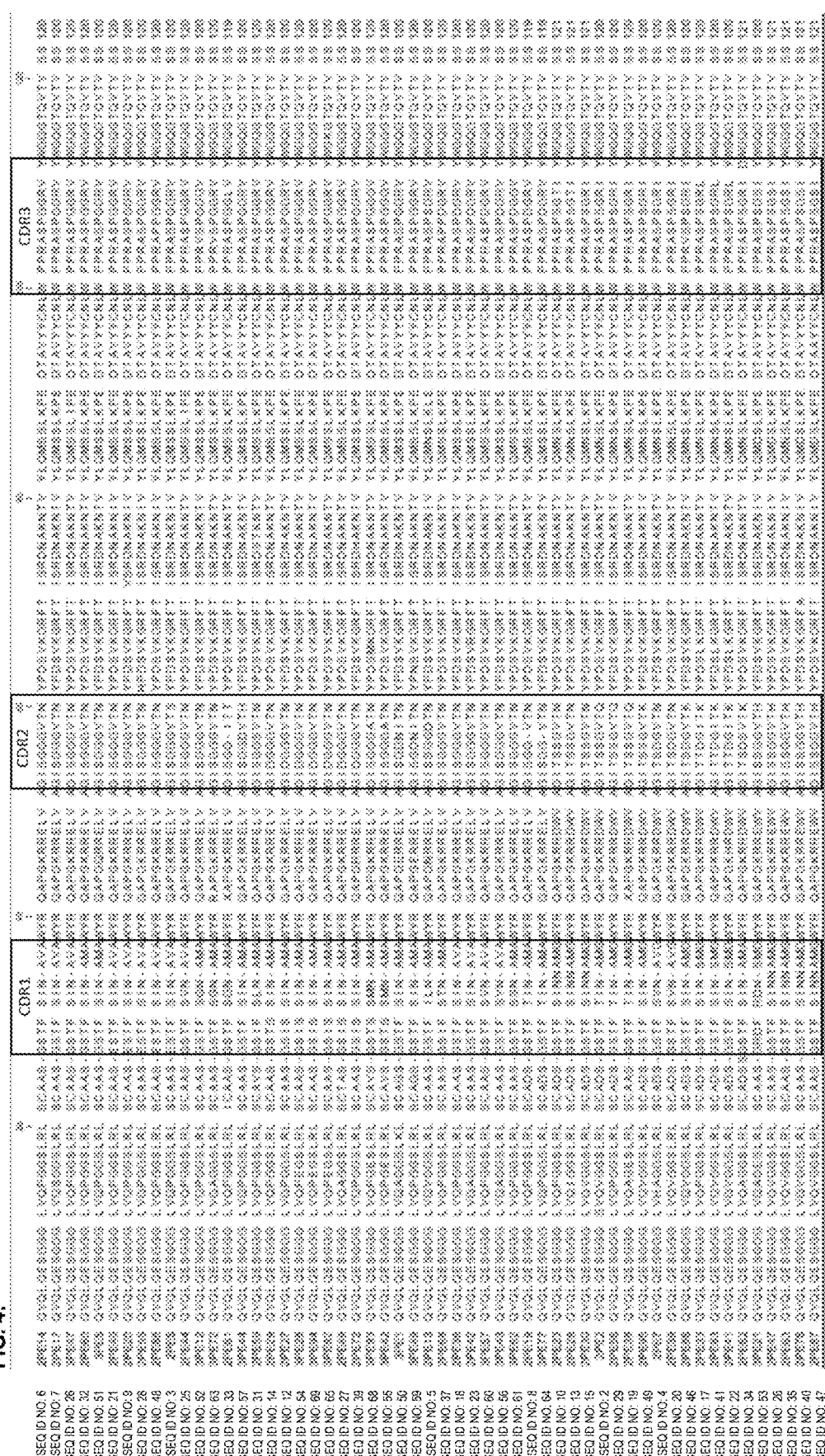
FIG. 4 shows protein sequence alignment for some embodiments of the human FAP binding VHHs. The boxes enclose CDR1, CDR2, CDR3 for these VHH sequences and show their alignment.
Figure 4:
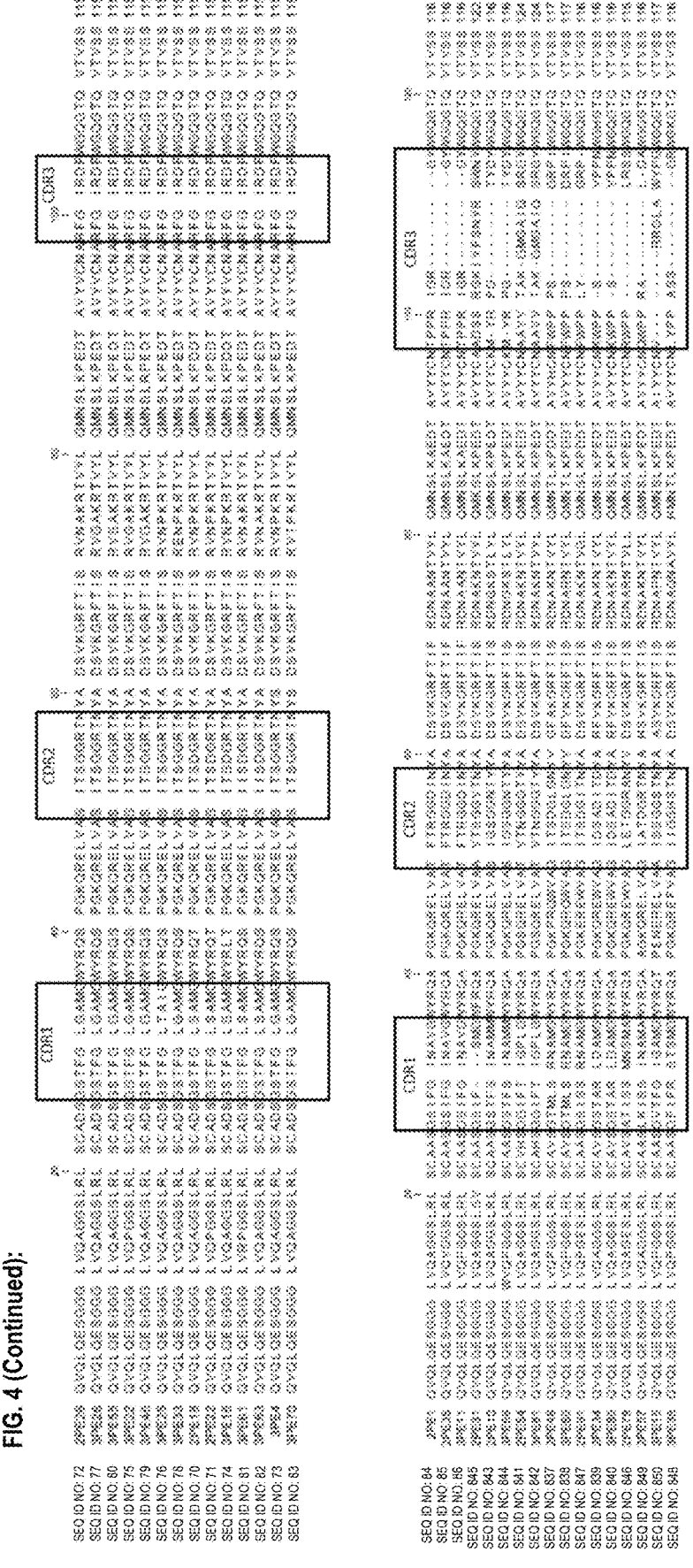
Figures 5A, 5B, 5C, 5D, 5E, 5F:
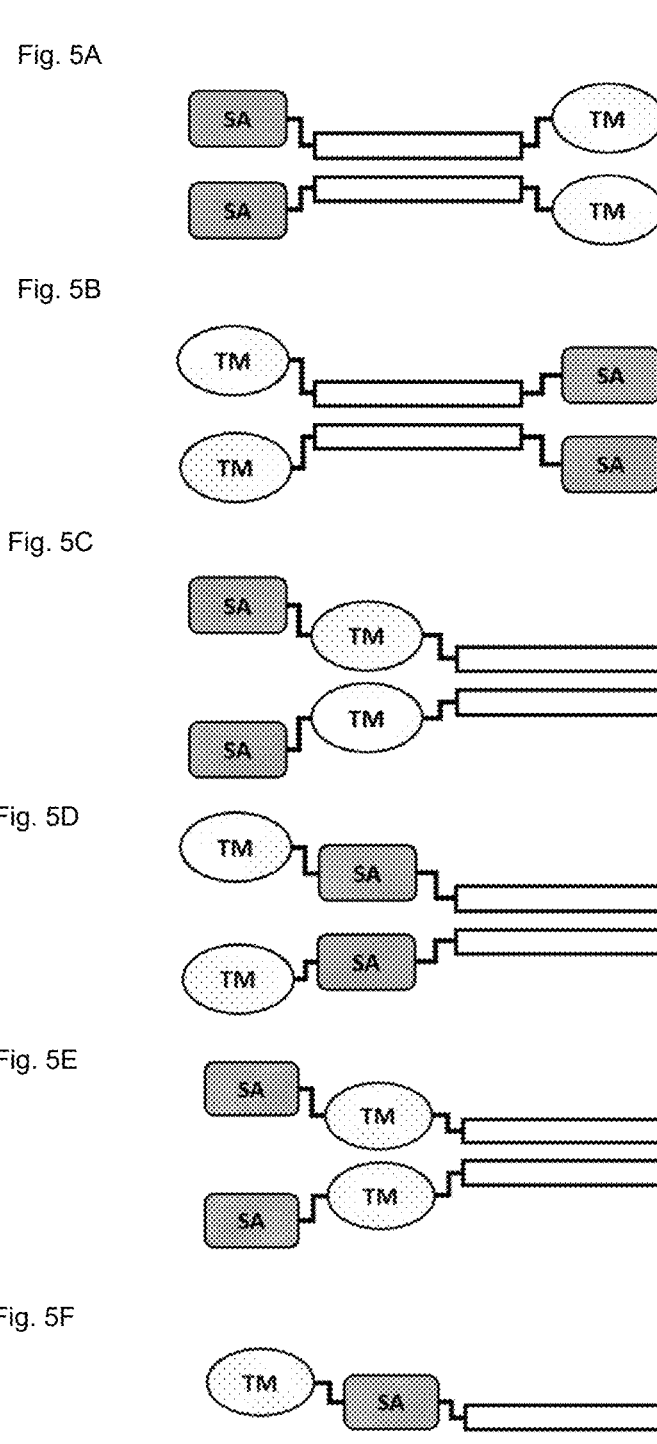
Figures 6E, 6F, 6G, 6H:
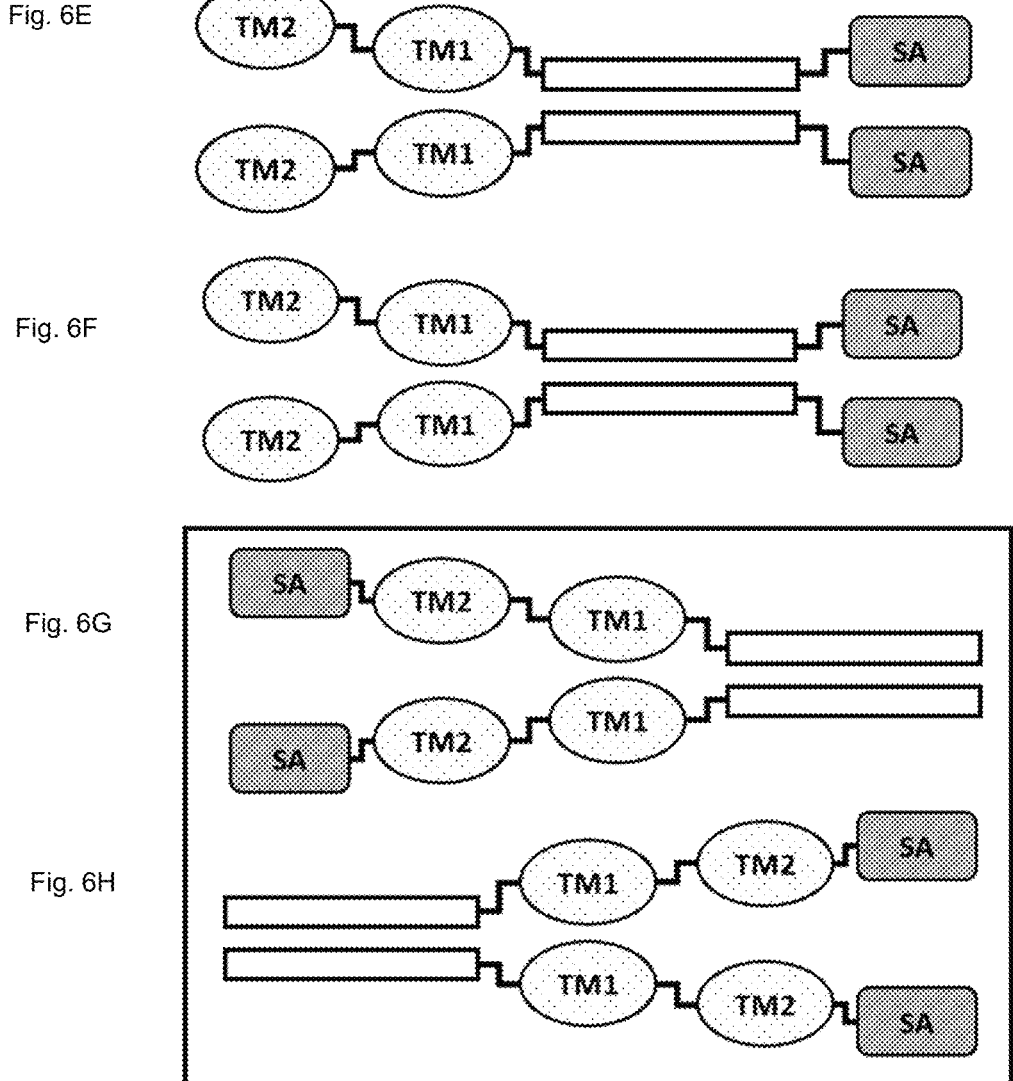
Figures 7A, 7B, 7C, 7D:
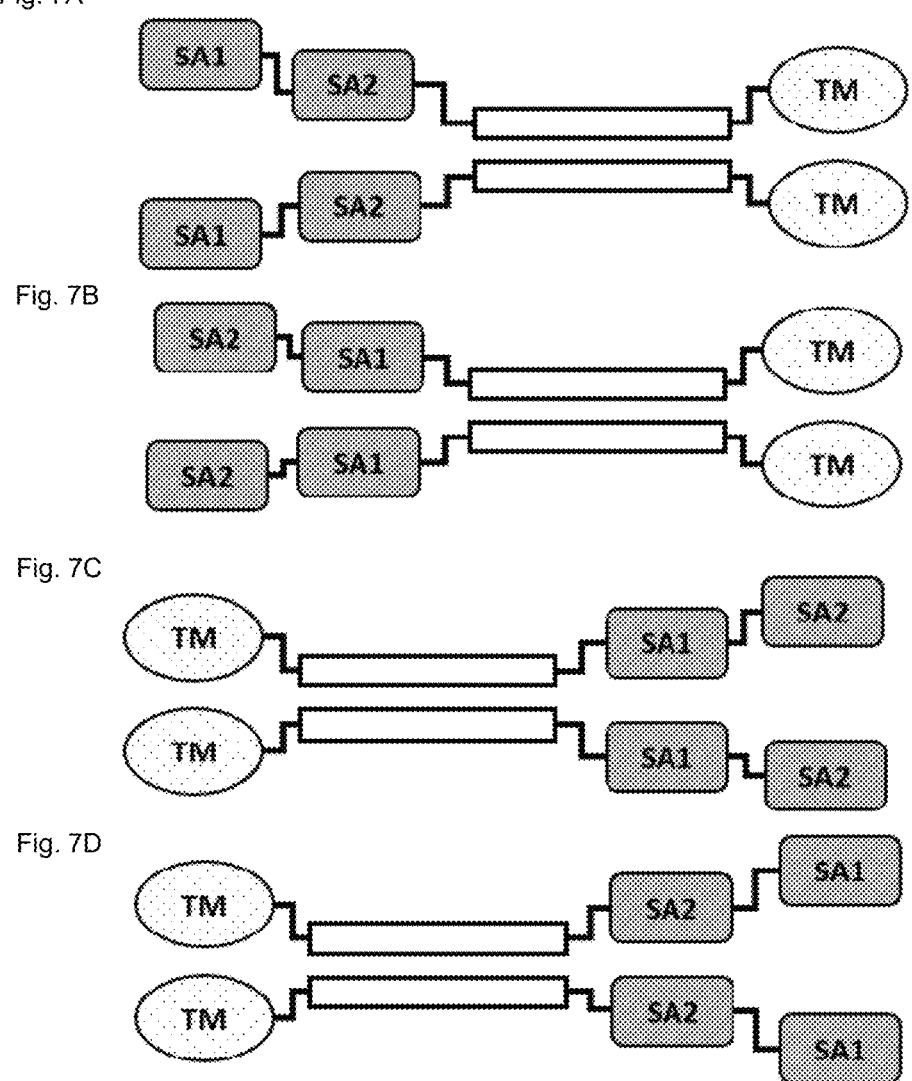
Figures 7E, 7F, 7G, 7H:
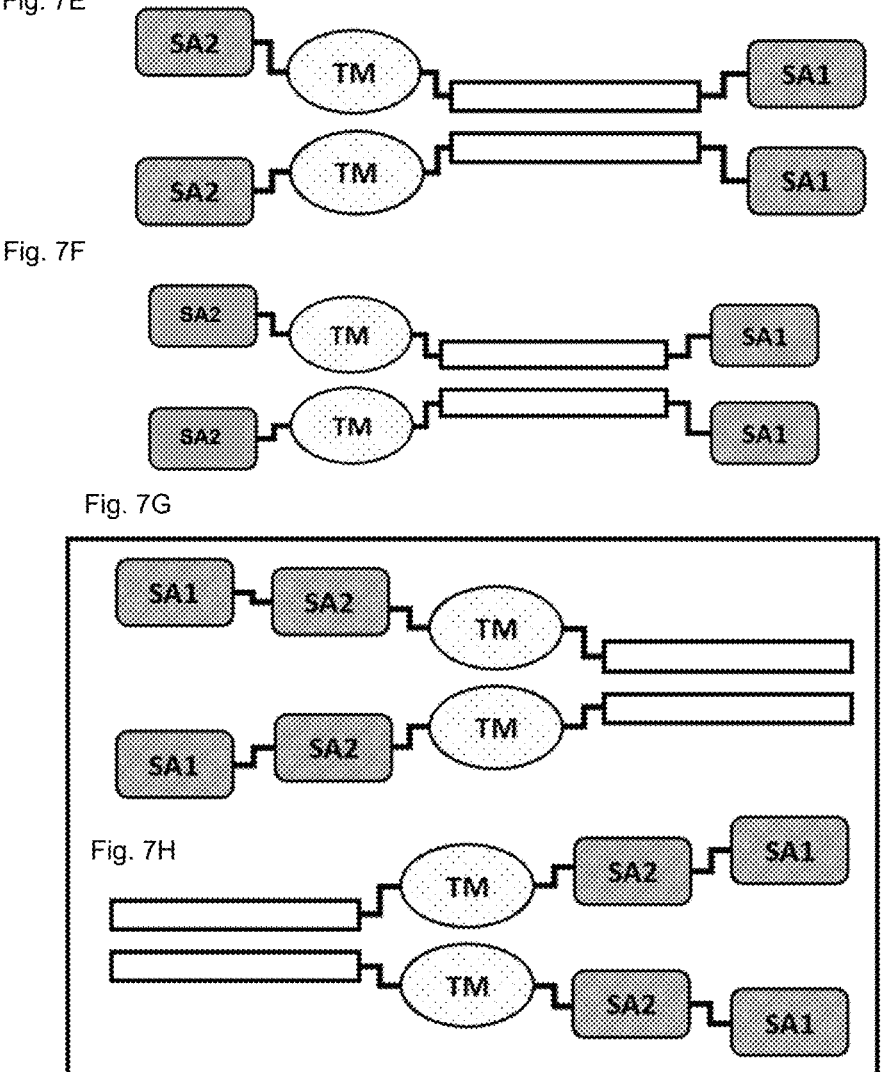
Figures 9A, 9B, 9C, 9D, 9E, 9F:
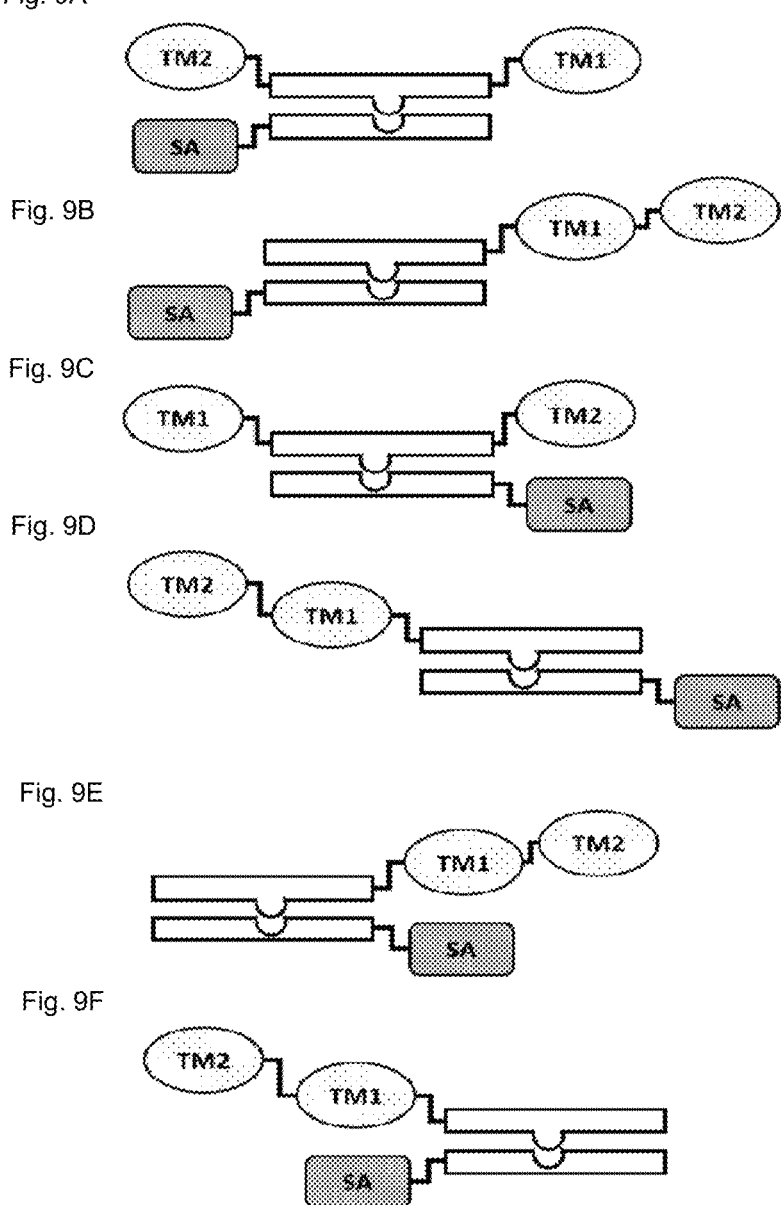
Figures 10A, 10B, 10C, 10D, 10E, 10F:
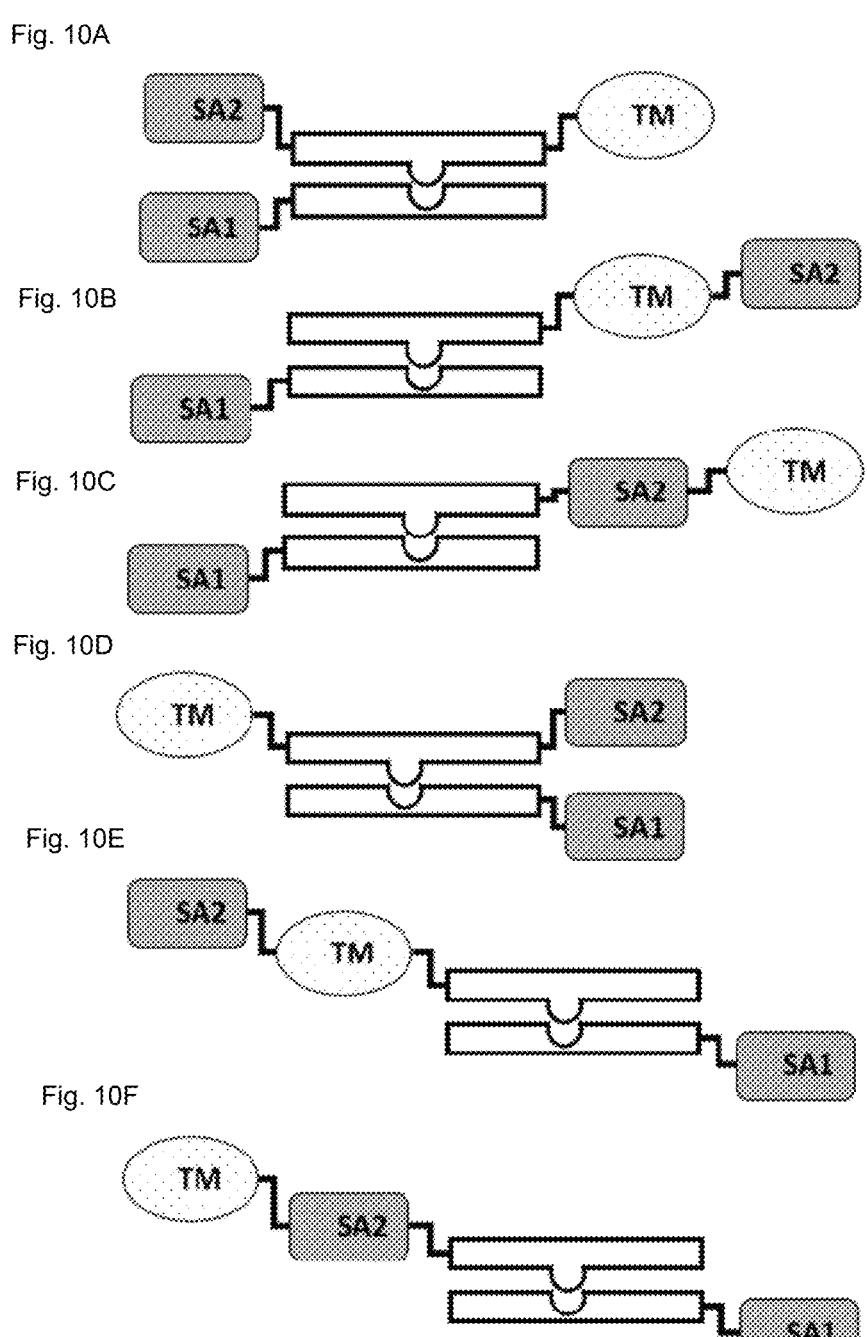
Figures 10G, 10H, 10I, 10J:
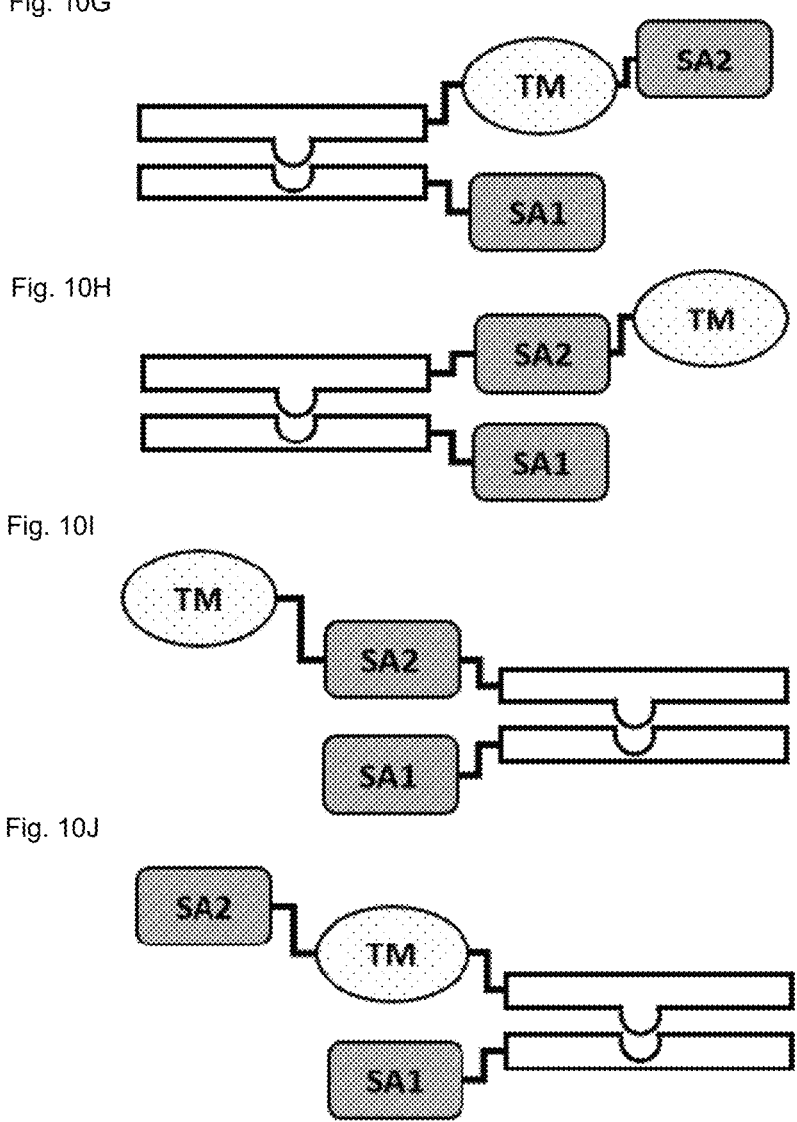
Figure 11A:
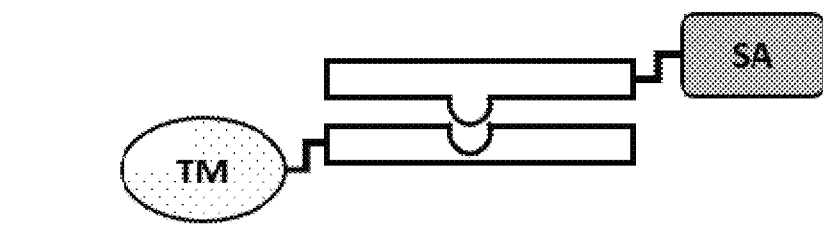
Figure 11B:
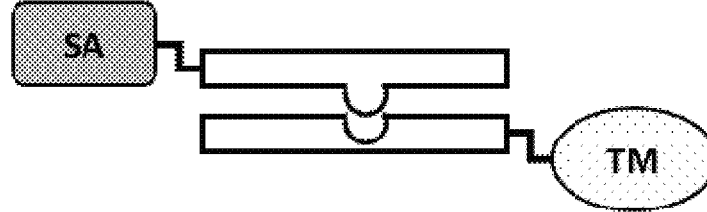
Figure 11C:
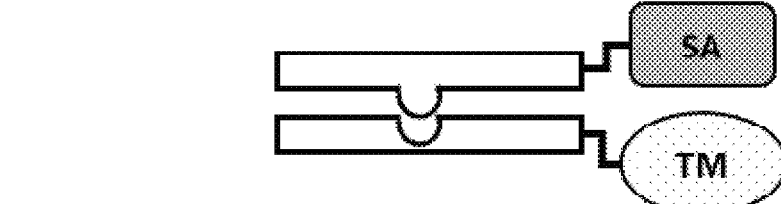
Figure 11D:
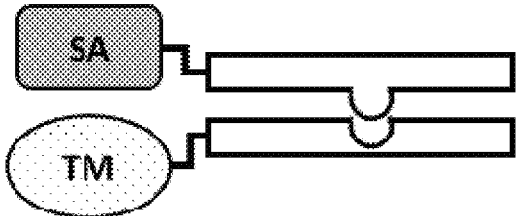
Figures 12A, 12B, 12C, 12D, 12E, 12F:
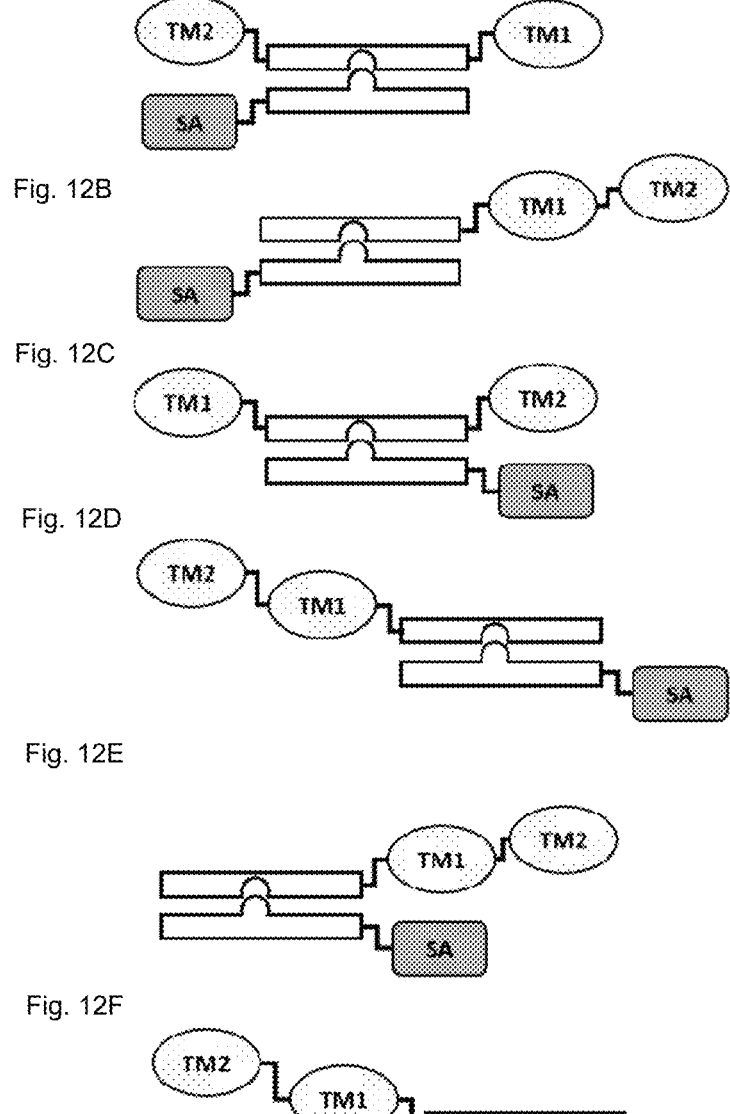
Figures 13A, 13B, 13C, 13D, 13E:
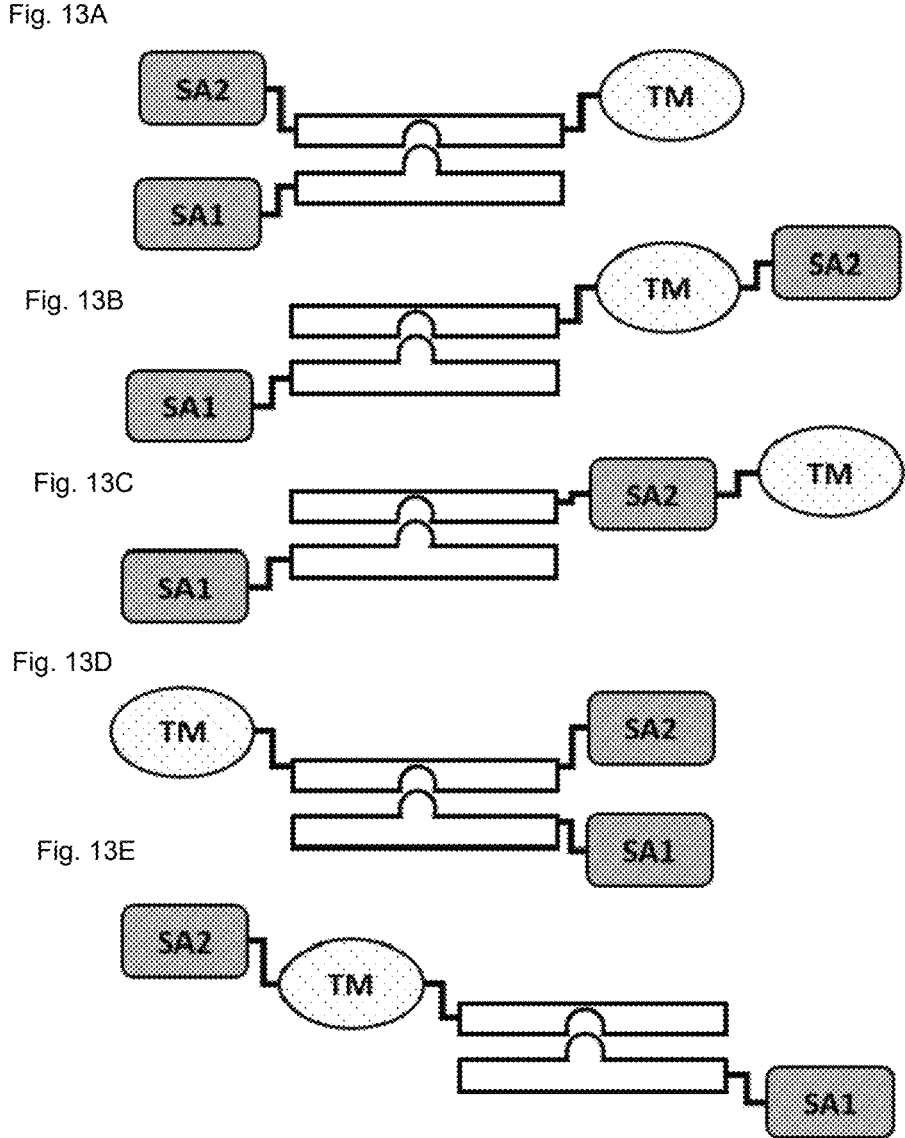
Figures 13F, 13G, 13H, 13I, 13J:
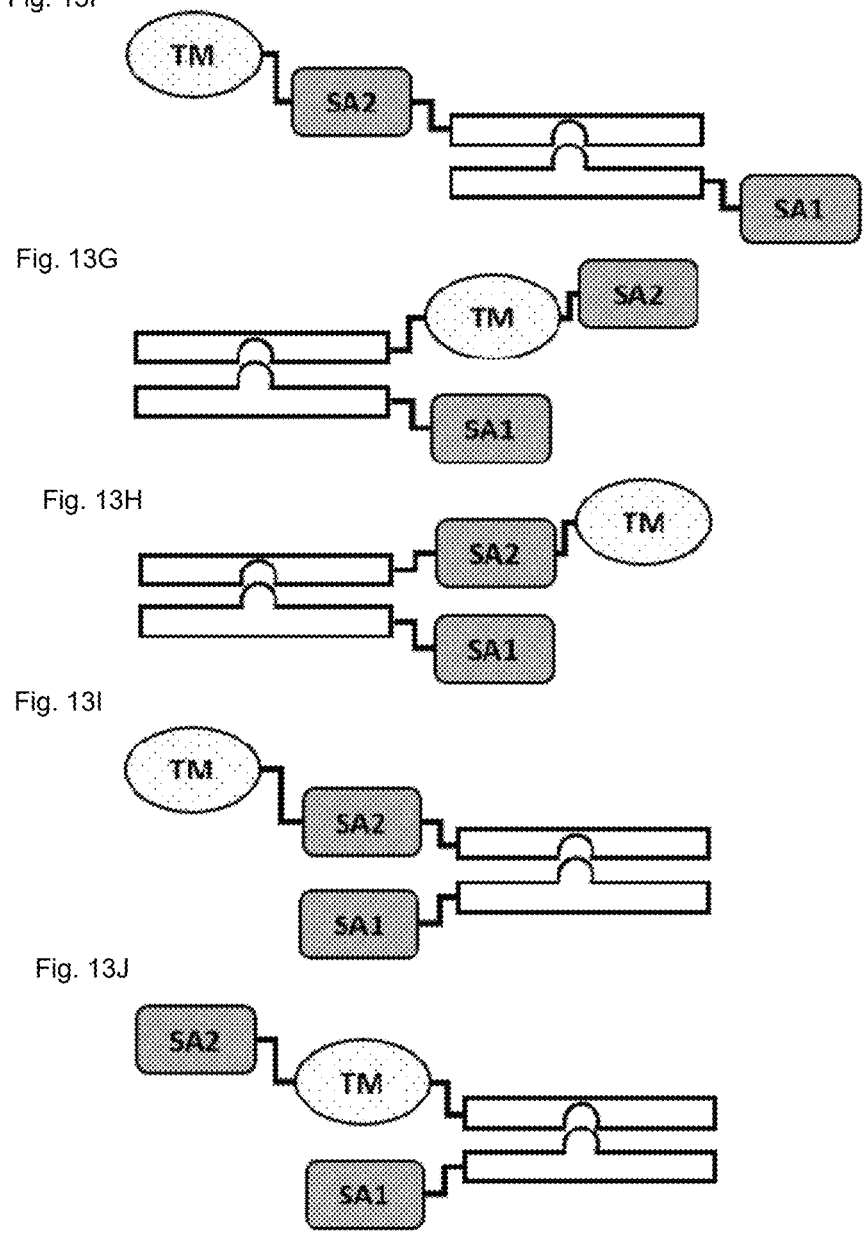
Figures 14A, 14B, 14C, 14D, 14E, 14F:
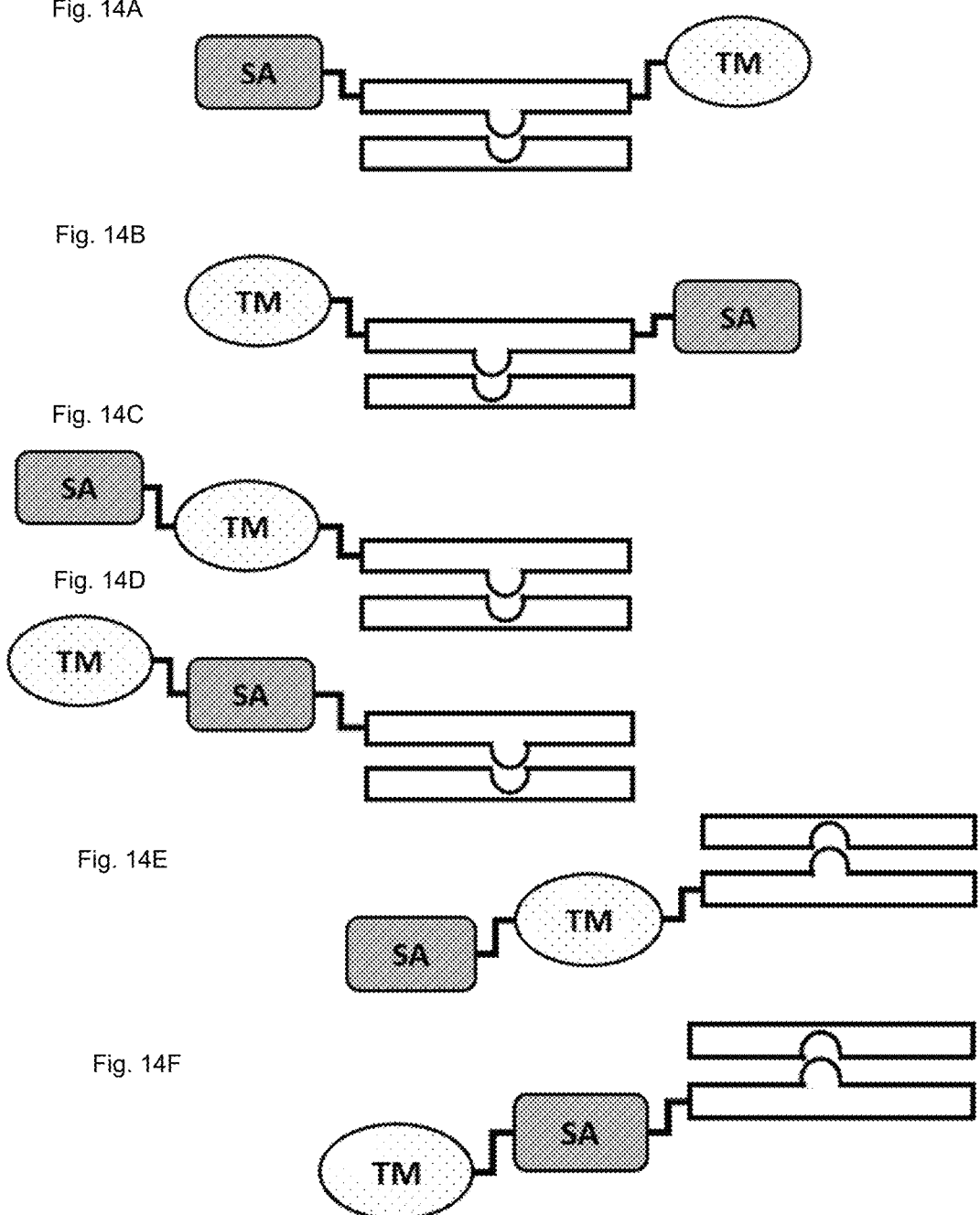
Figures 15A, 15B, 15C, 15D, 15E:
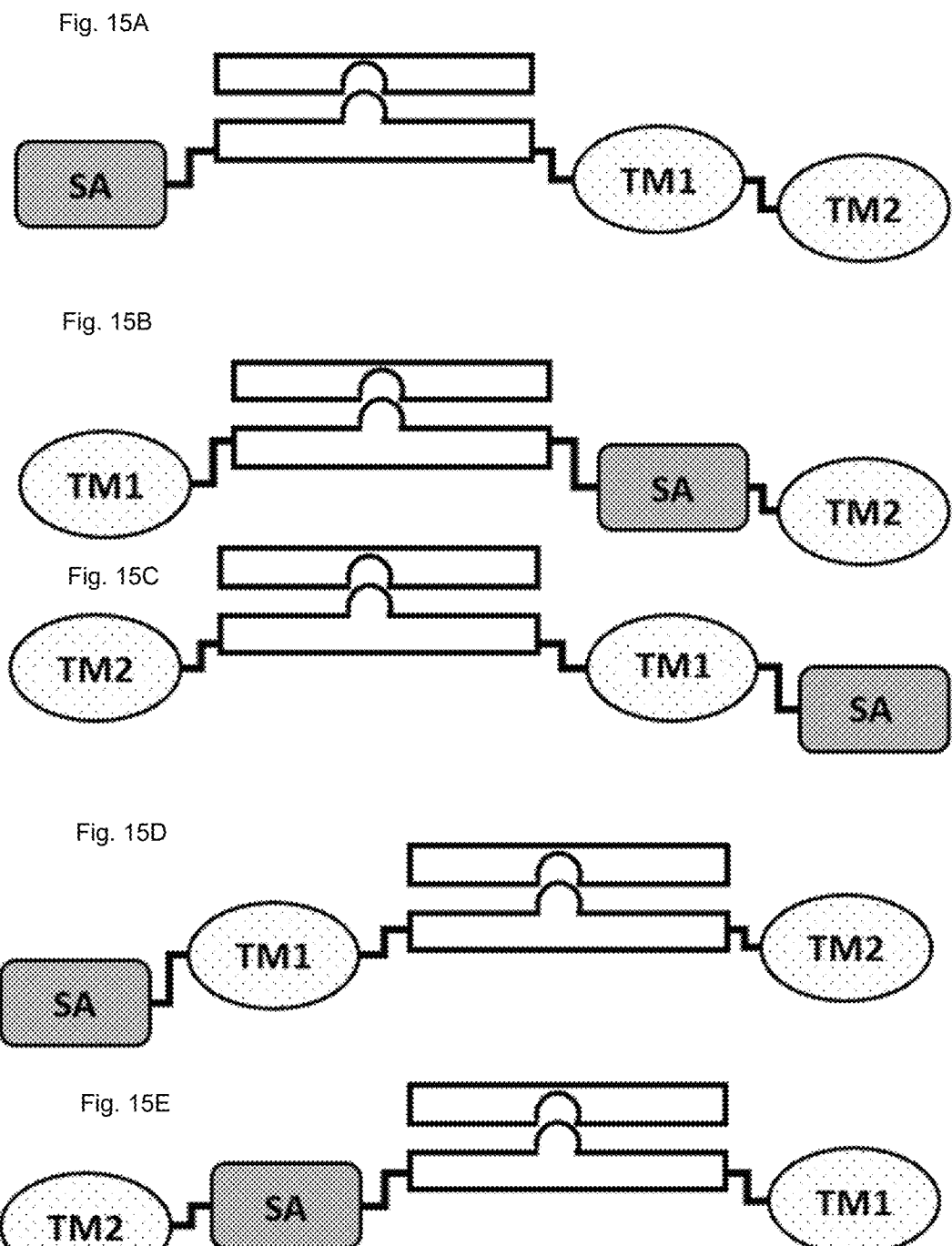
Figures 15F, 15G, 15H, 15I, 15J, 15K, 15L:
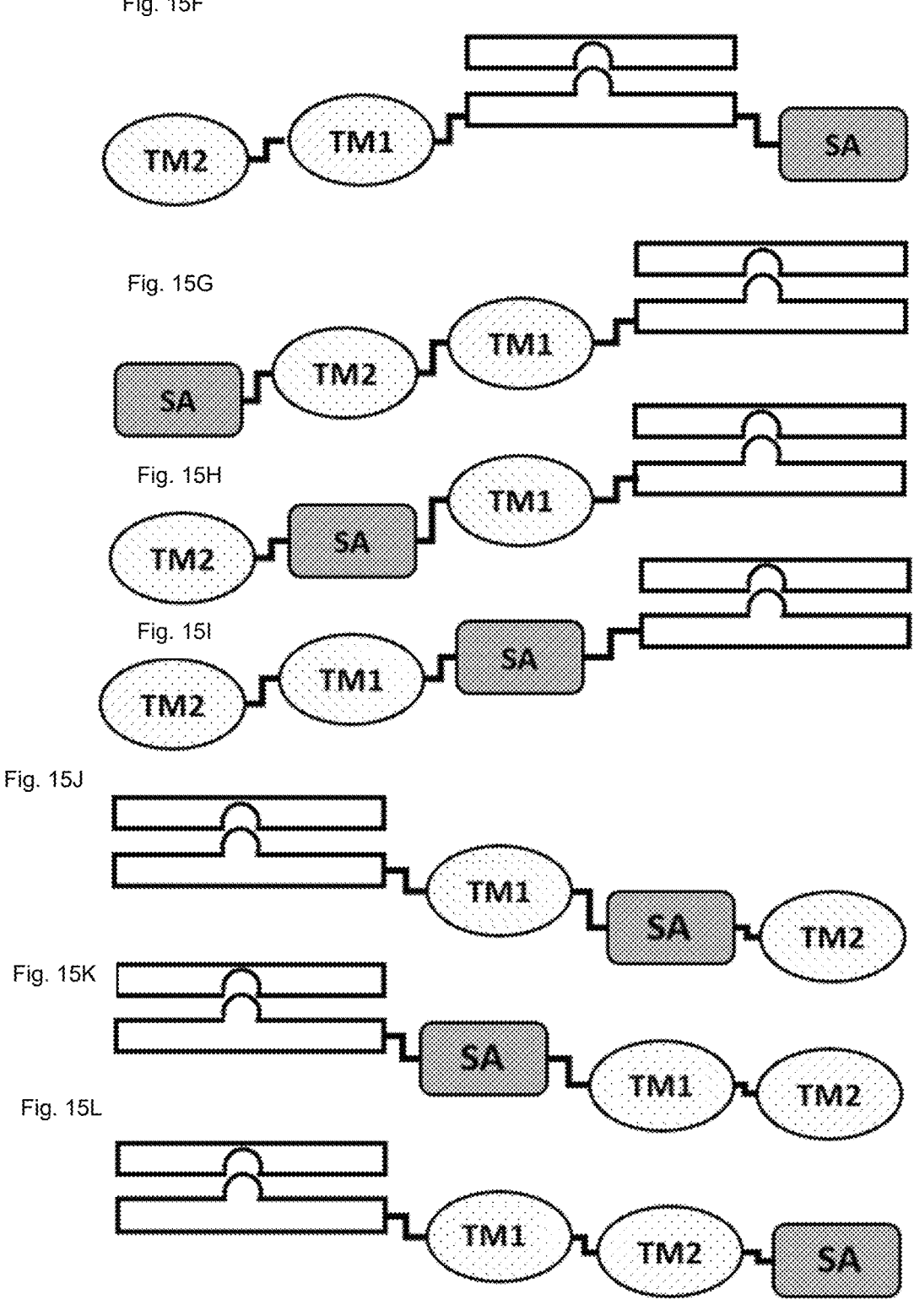
Figures 16A, 16B, 16C, 16D, 16E, 16F:
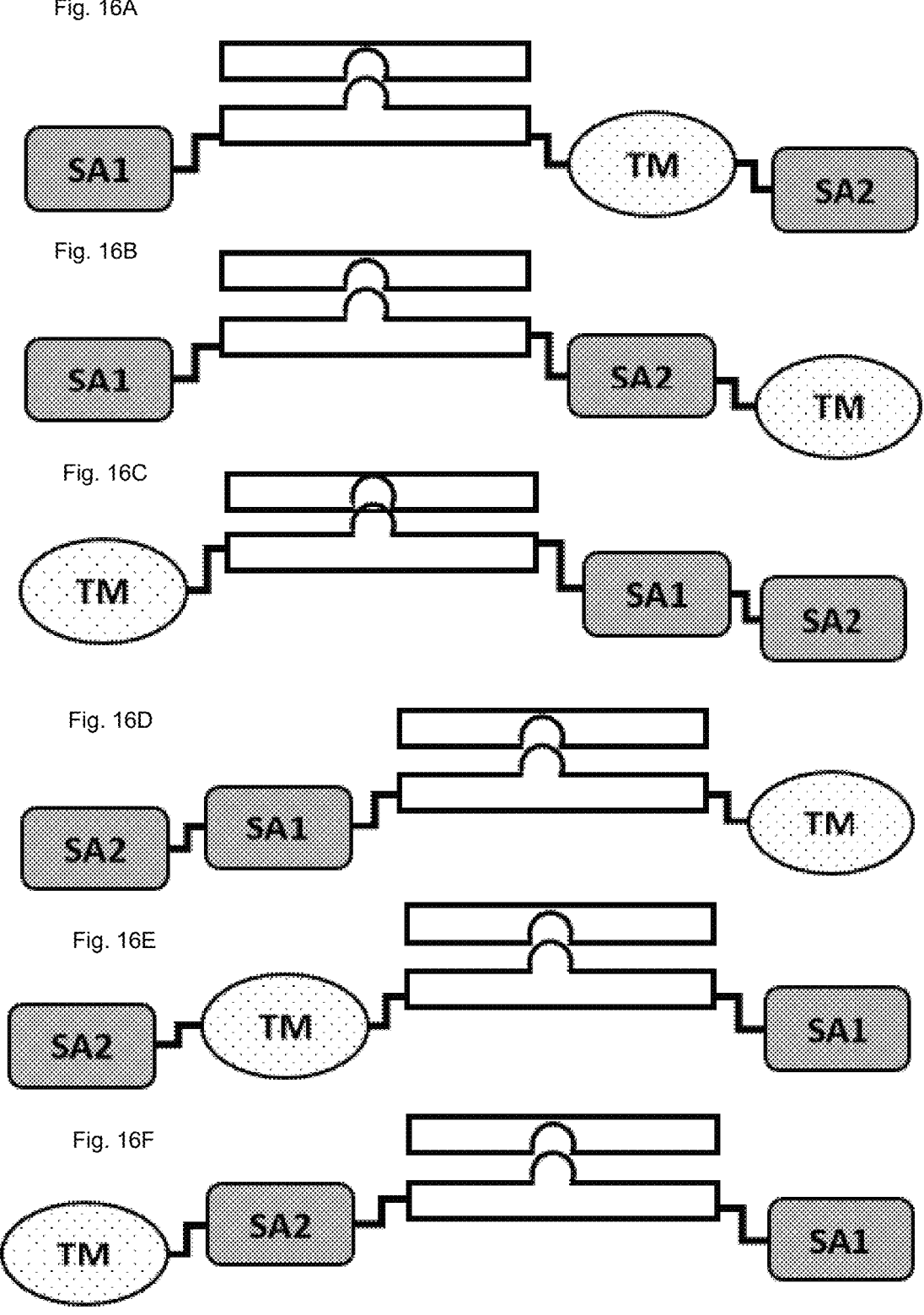
Figures 16G, 16H, 16I, 16J, 16K, 16L:
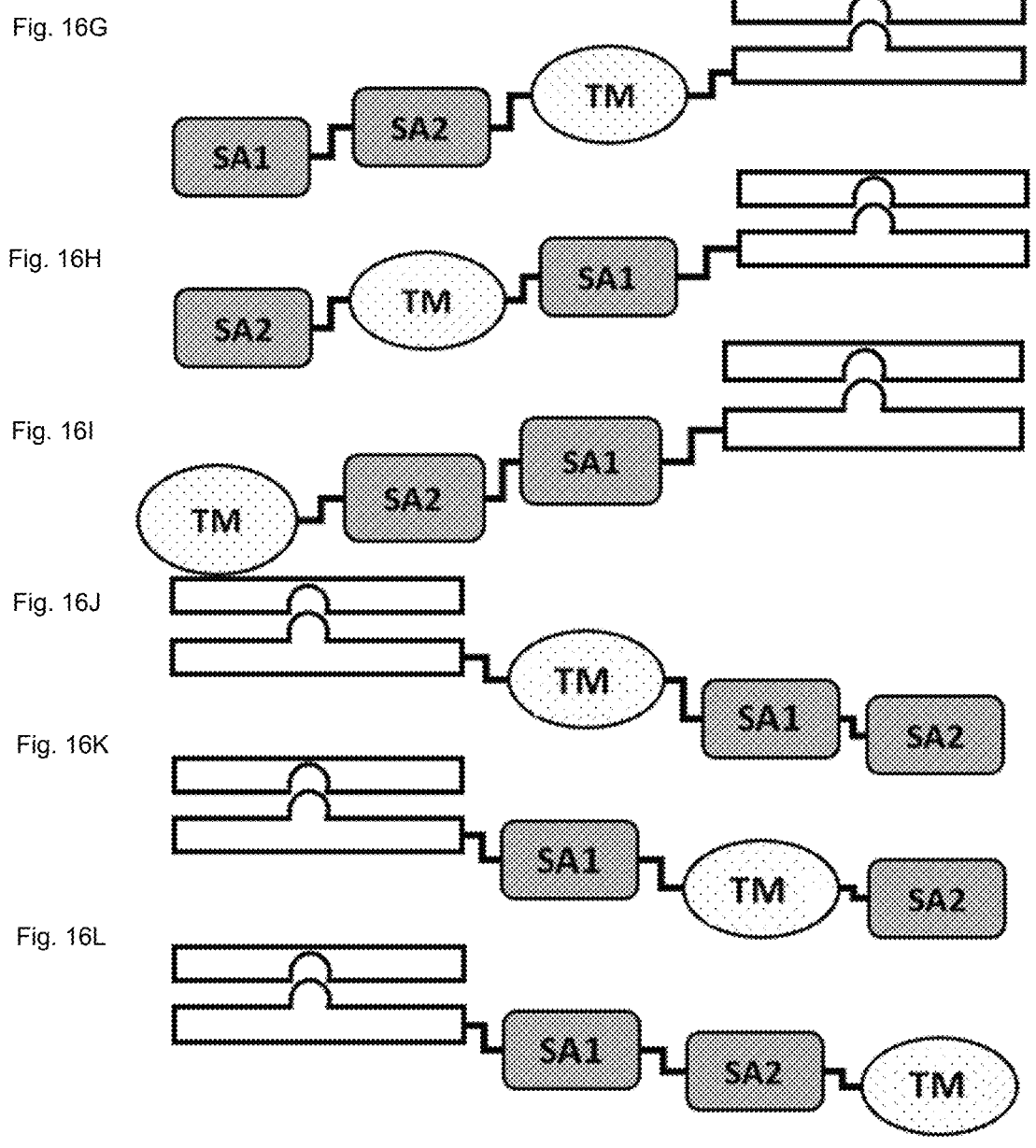
Figures 17A, 17B, 17C, 17D, 17E, 17F:
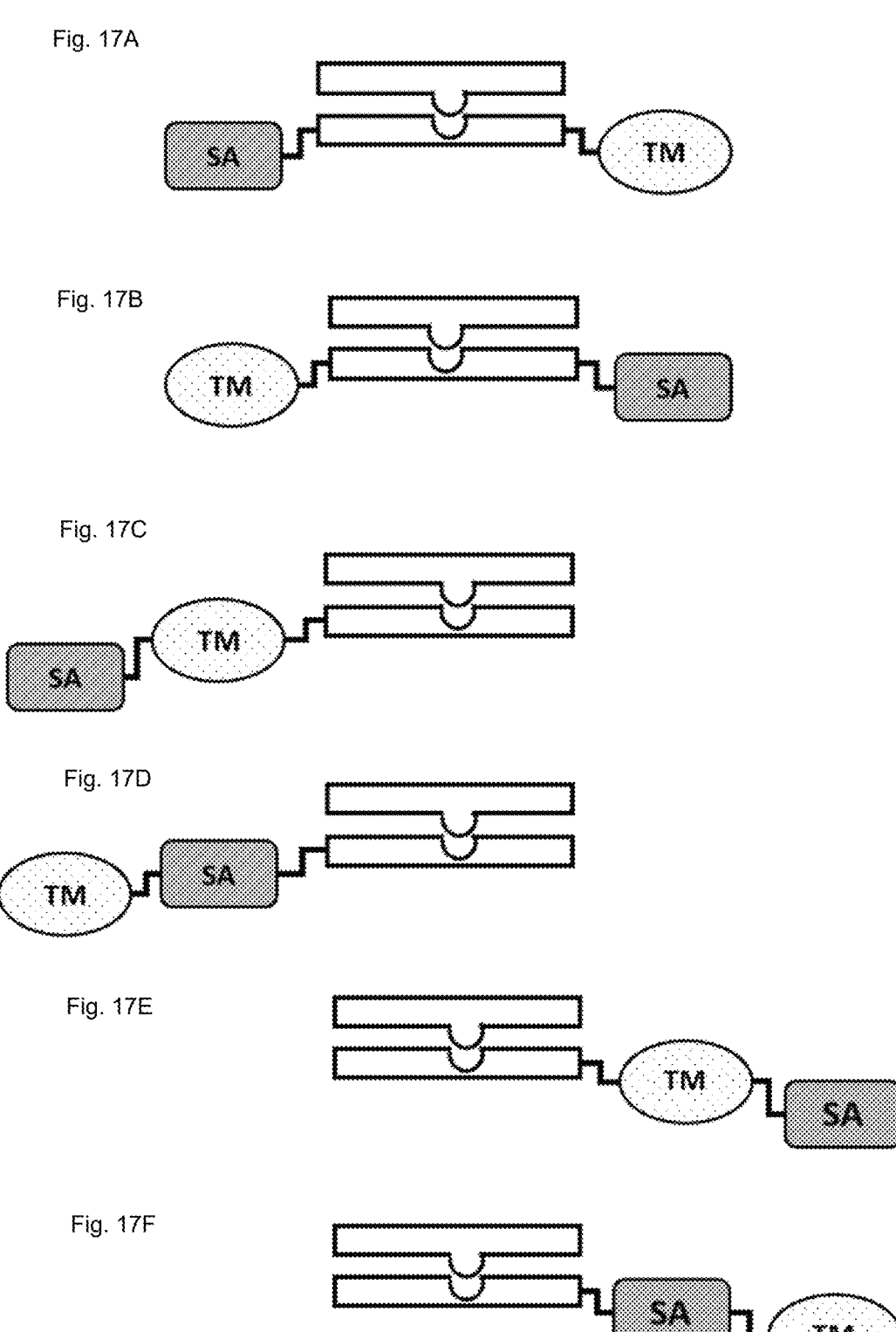
Figures 18A, 18B, 18C, 18D, 18E, 18F:
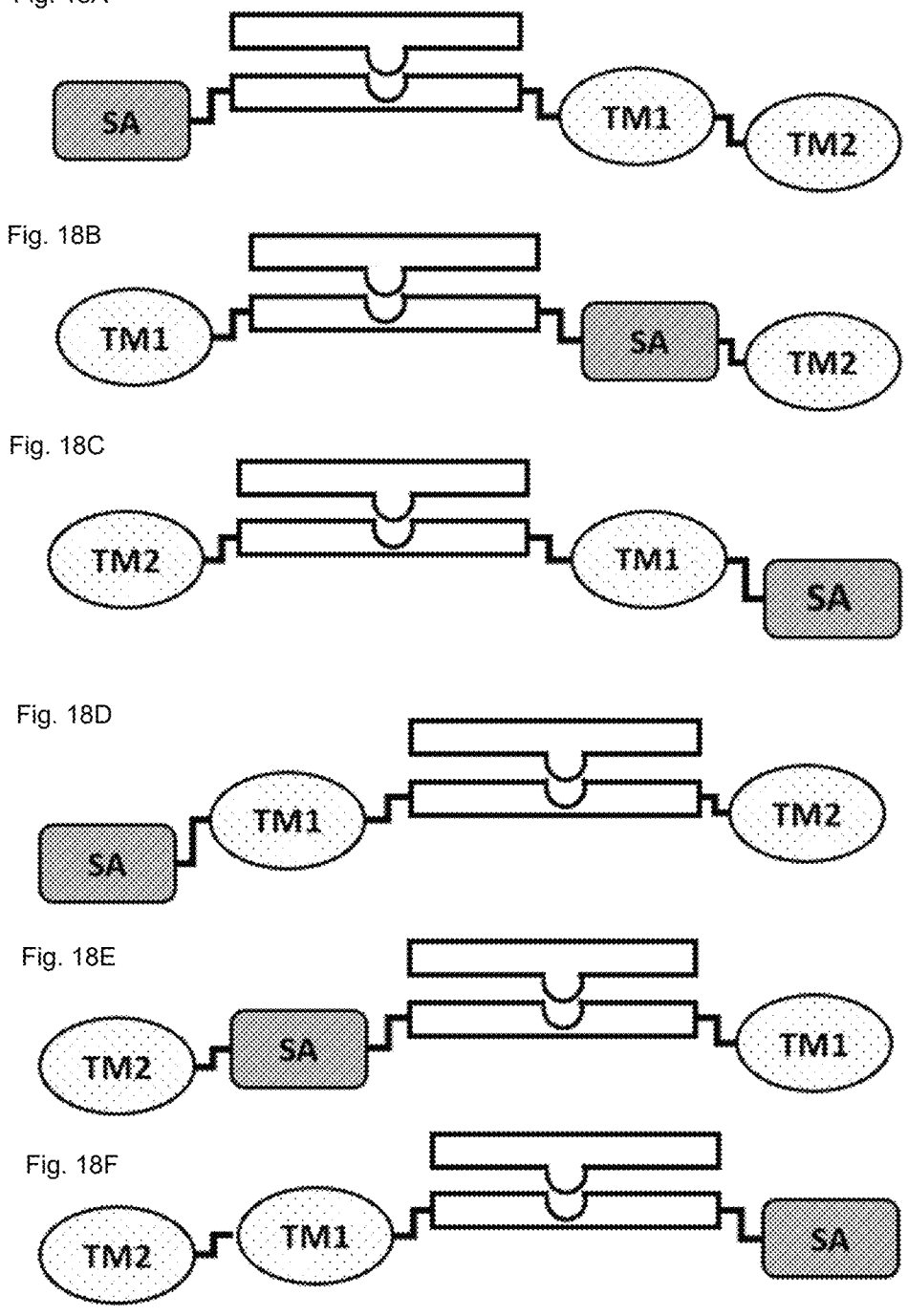
Figures 18G, 18H, 18I, 18J, 18K, 18L:
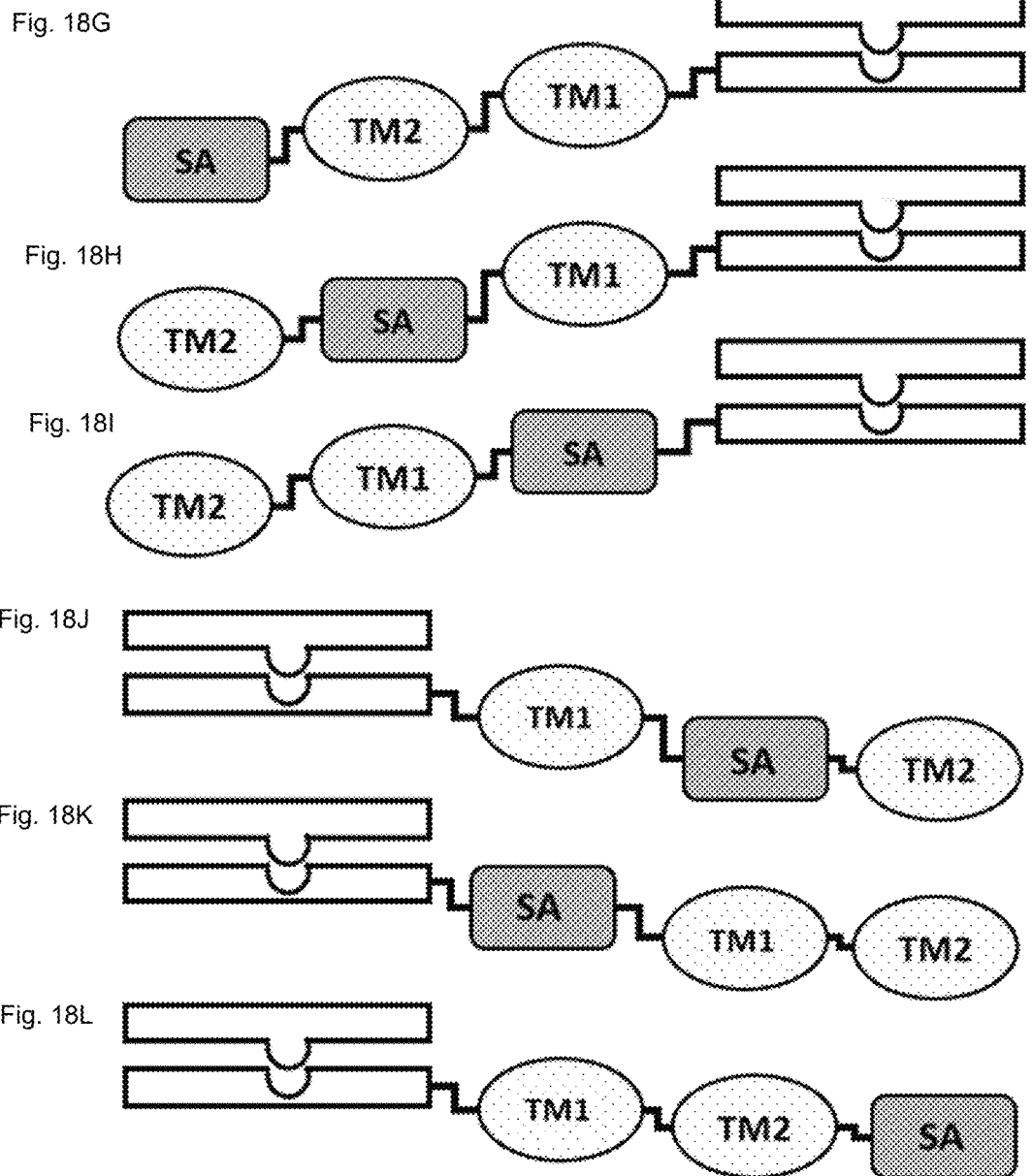
Figures 19A, 19B, 19C, 19D, 19E, 19F:
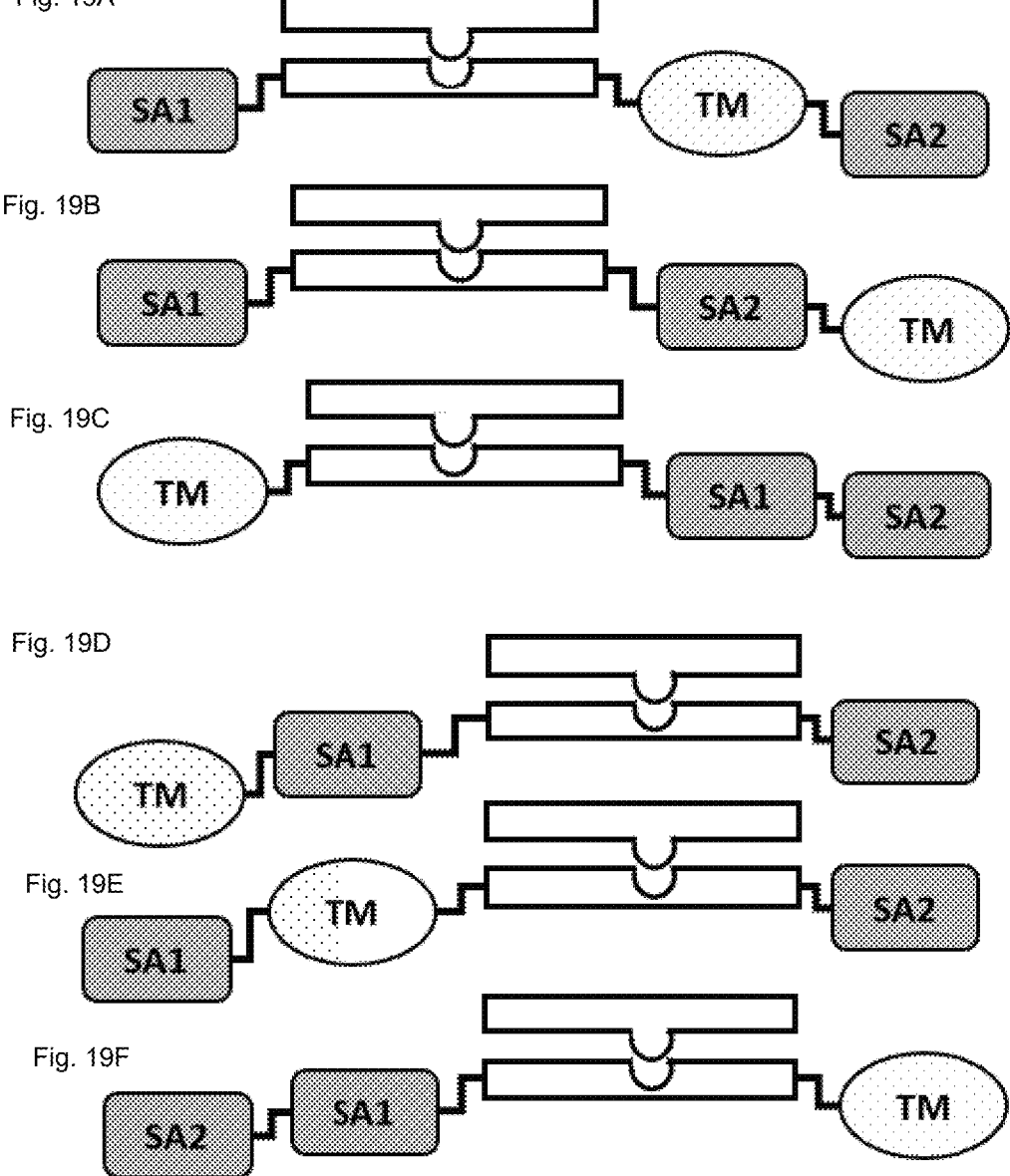
Figures 19G, 19H, 19I, 19J, 19K, 19L:
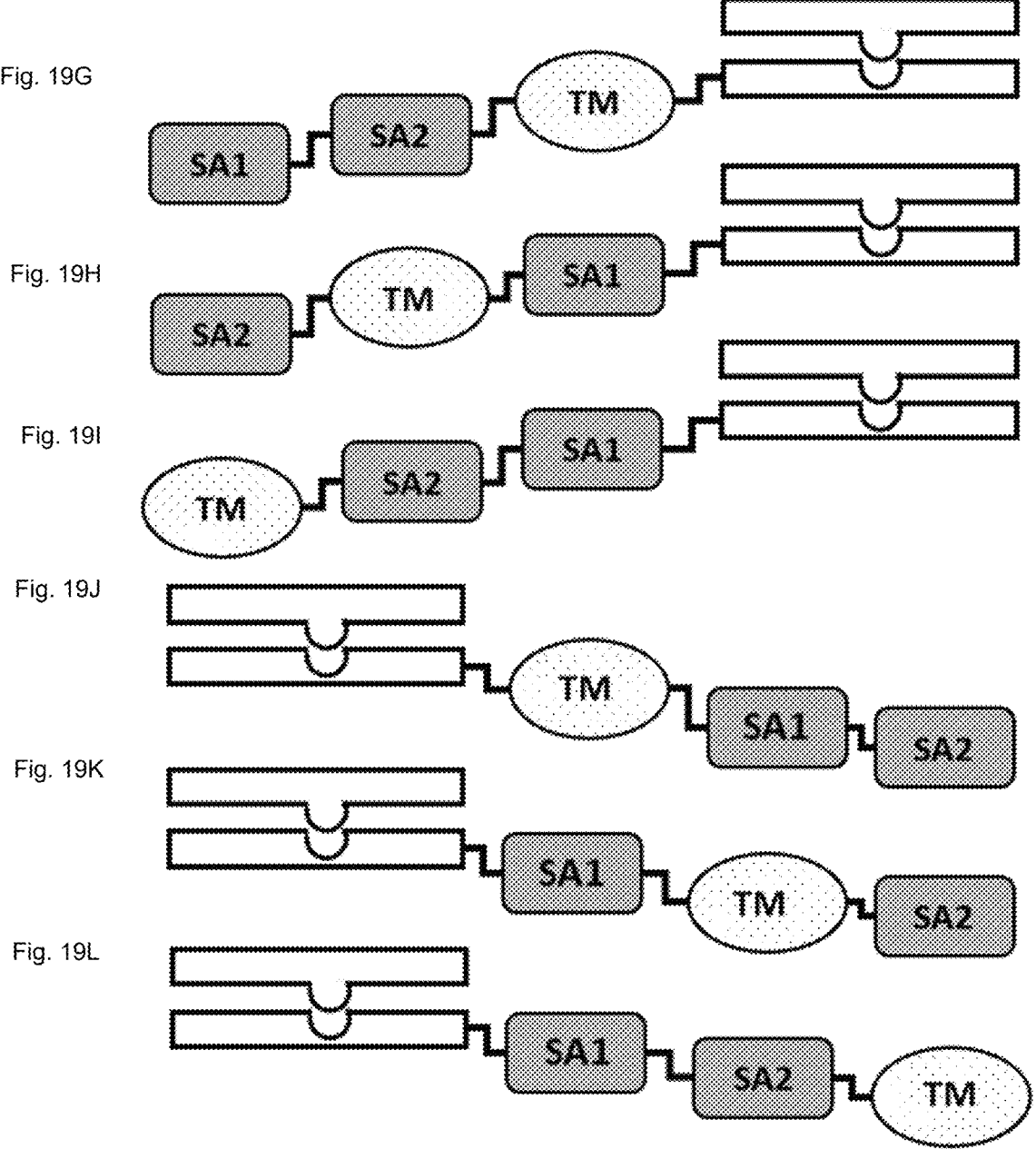
Figures 20A, 20B, 20C, 20D, 20E:
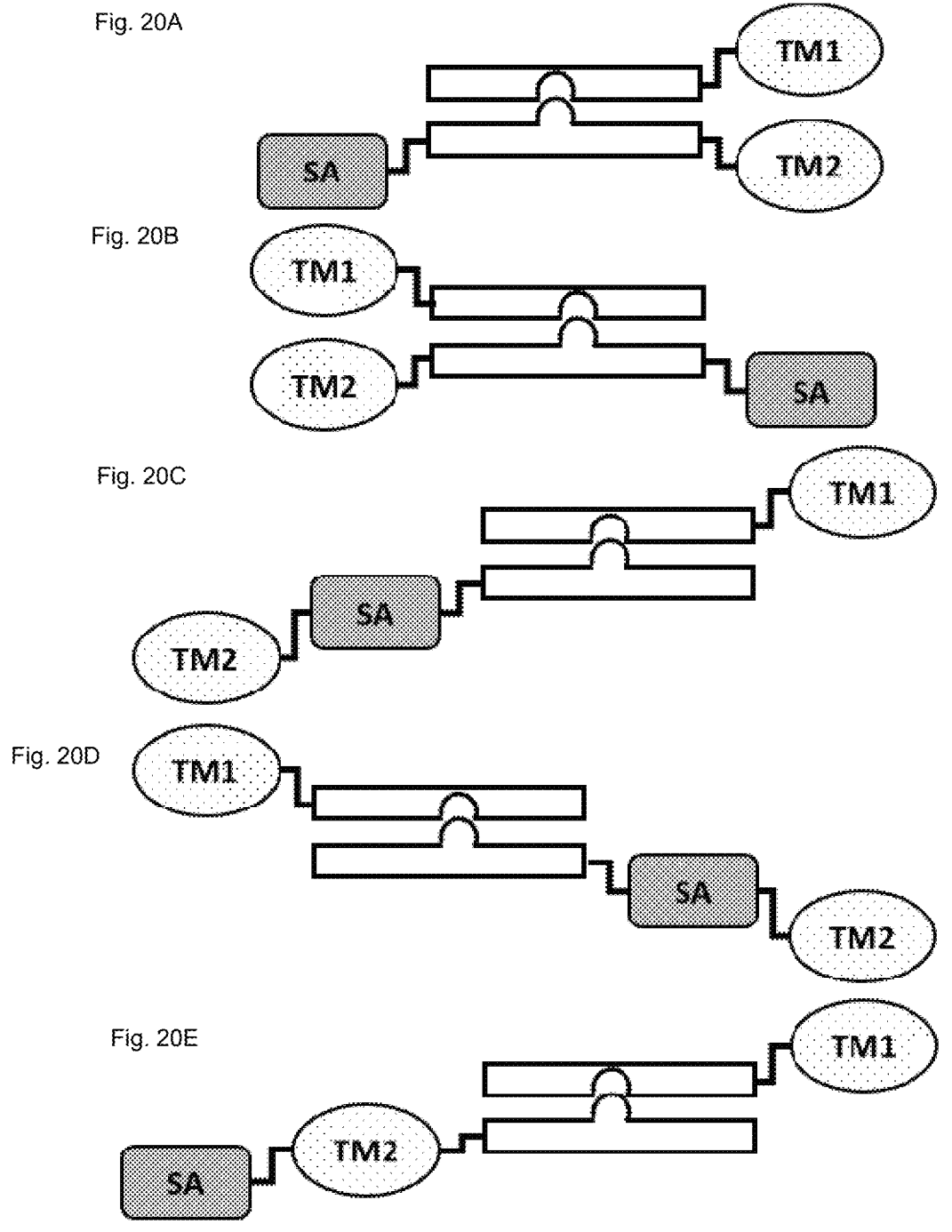
Figures 20F, 20G, 20H, 20I, 20J:
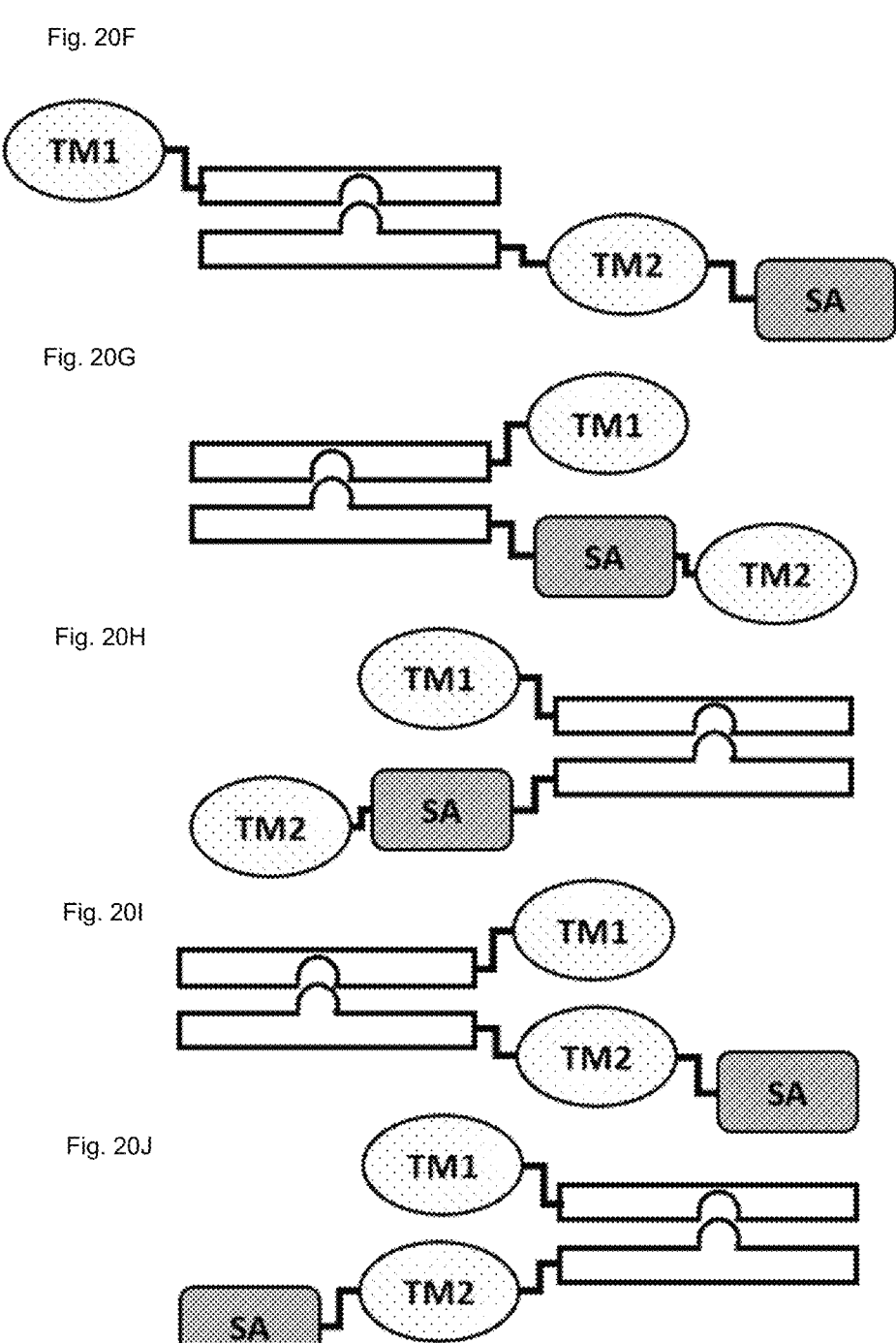
Figures 21A, 21B, 21C, 21D, 21E:
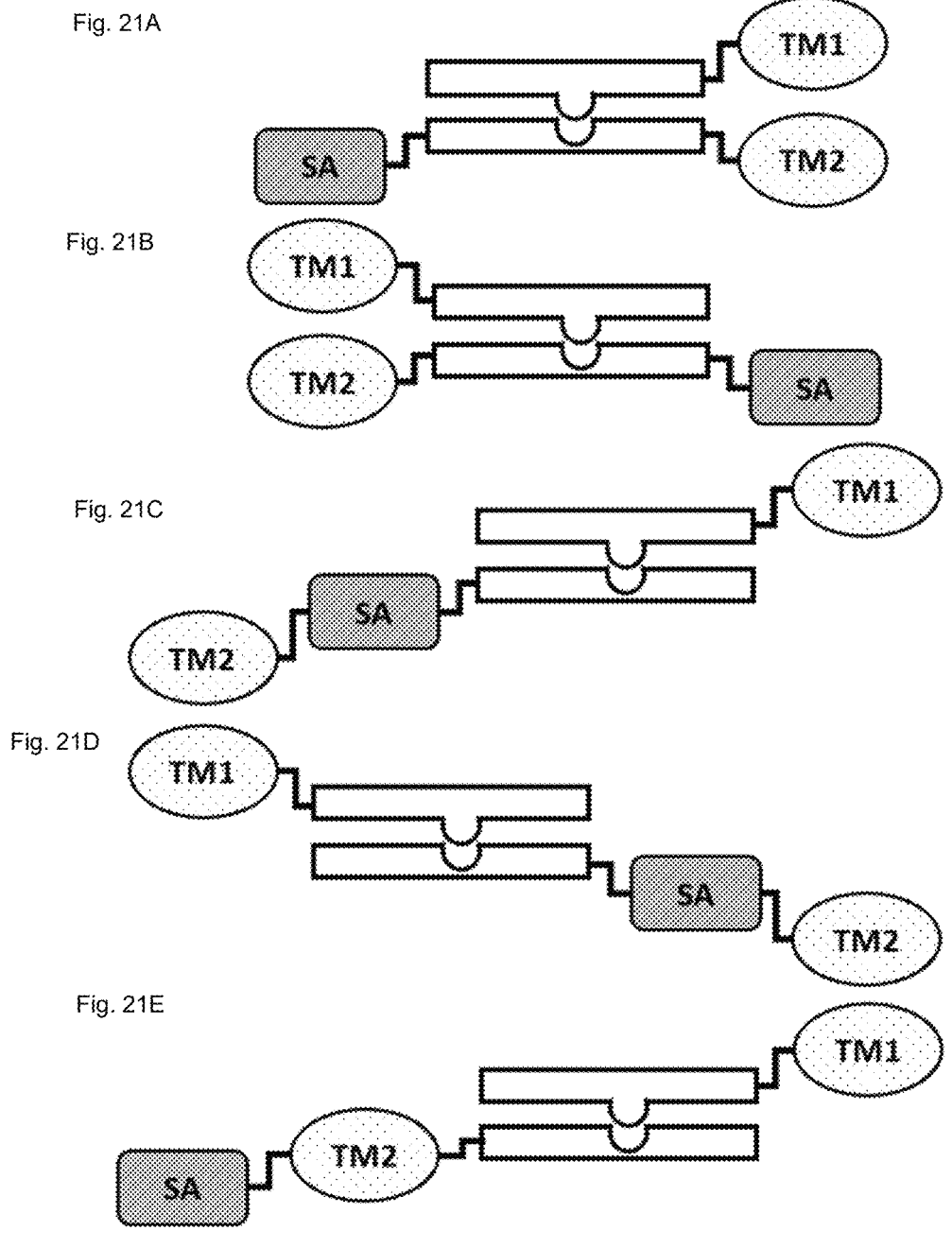
Figures 21F, 21G, 21H, 21I, 21J:
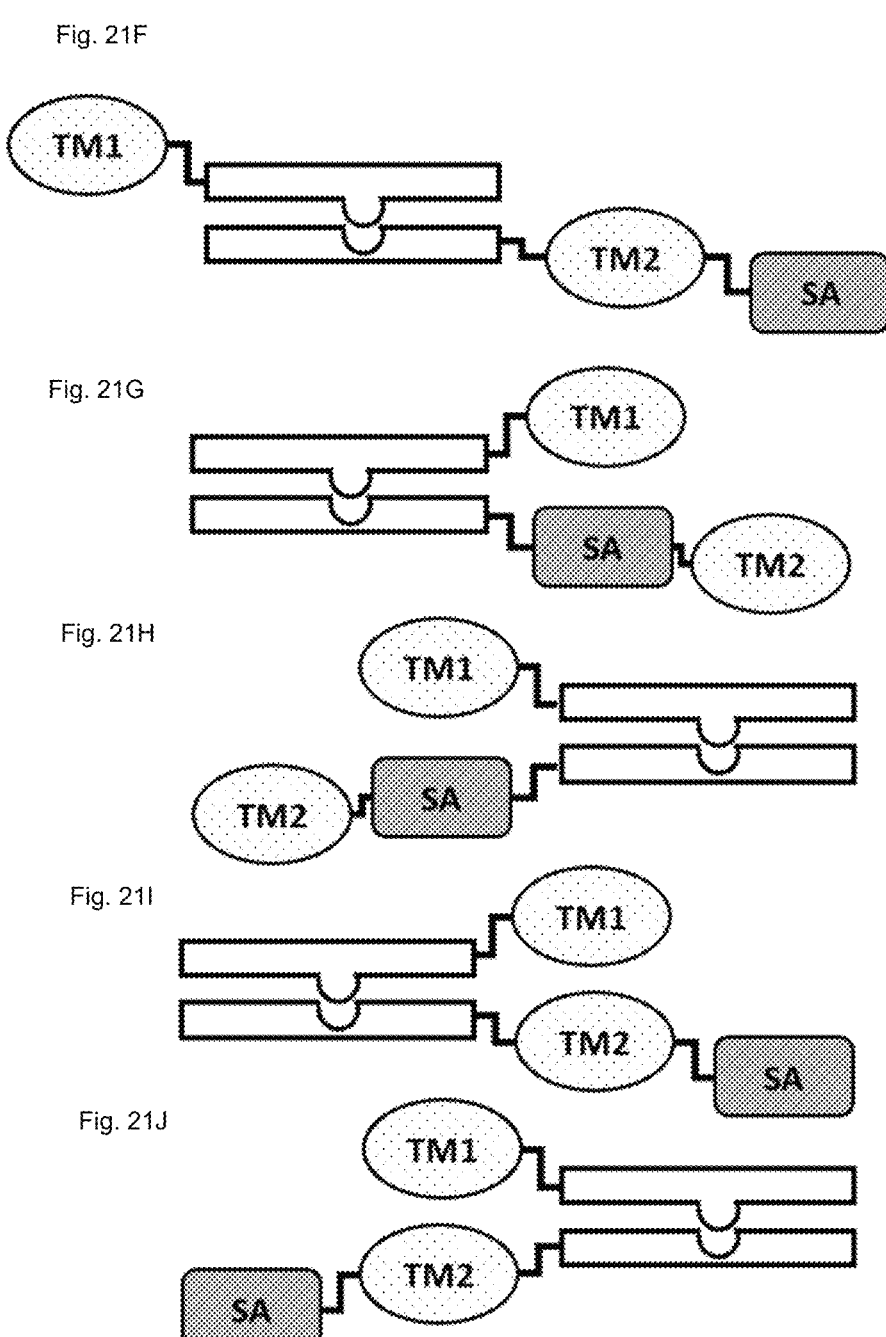
Figure 24A:
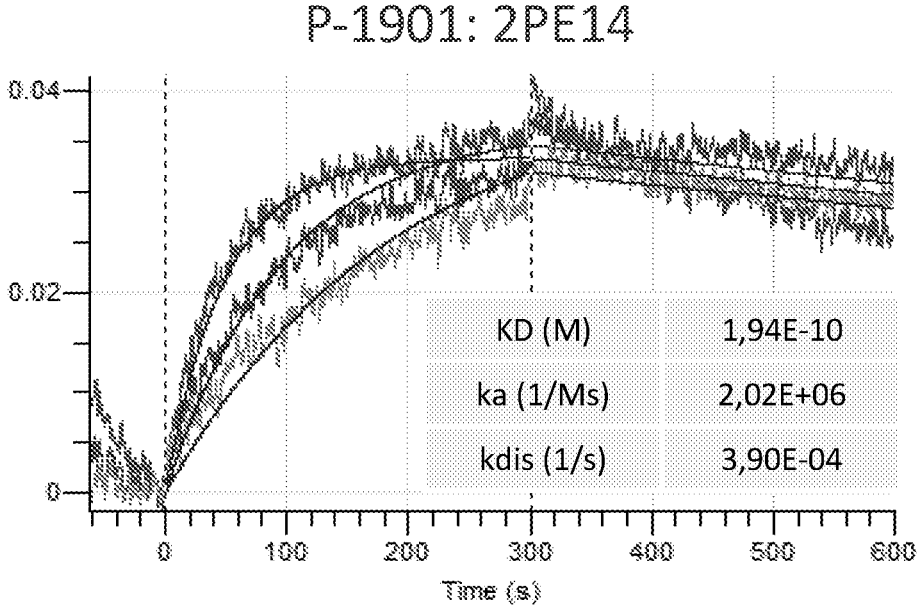
Figure 24B:
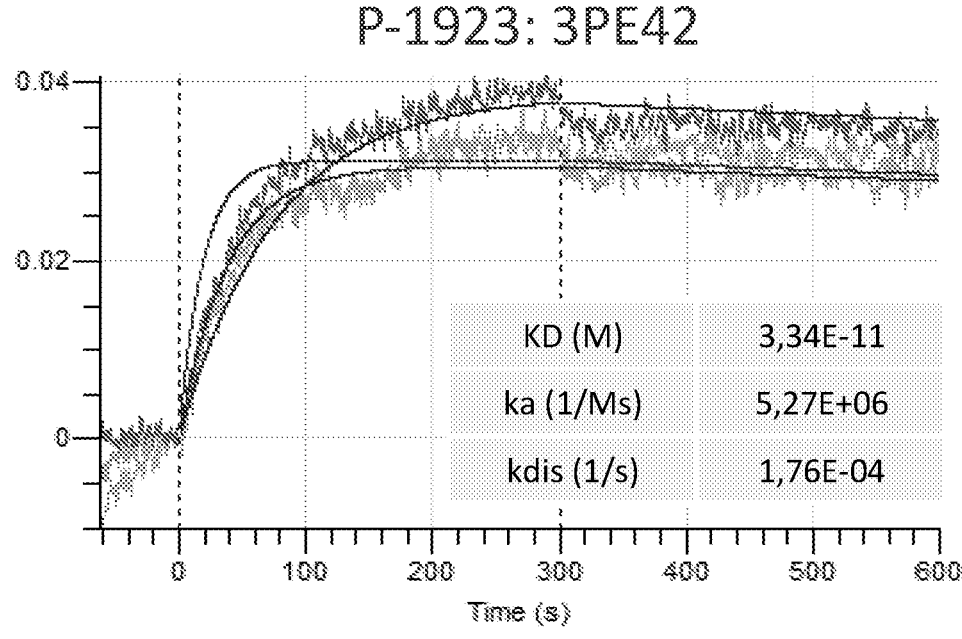
Figure 24C:
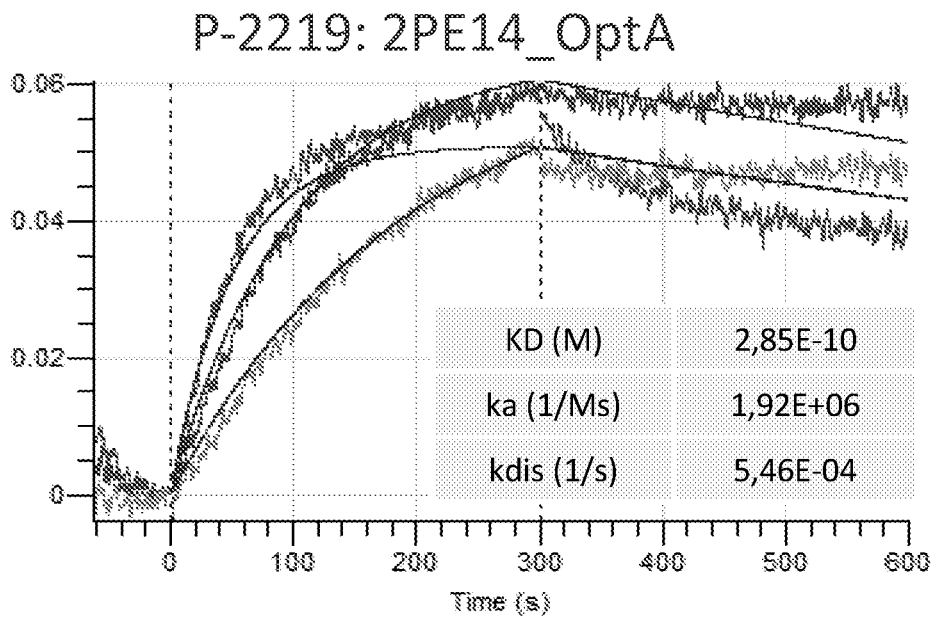
Figure 24D:
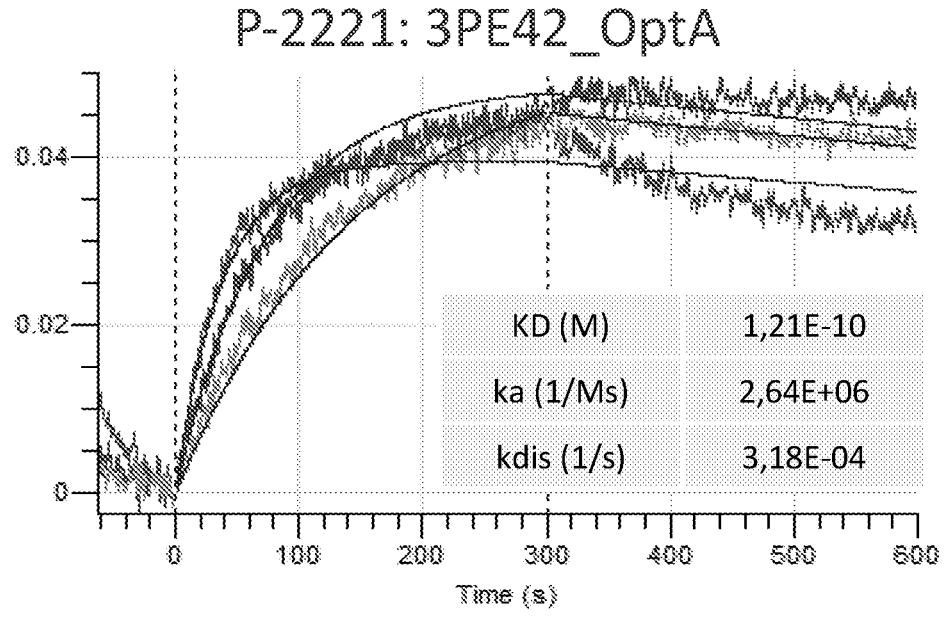
Figure 24E:
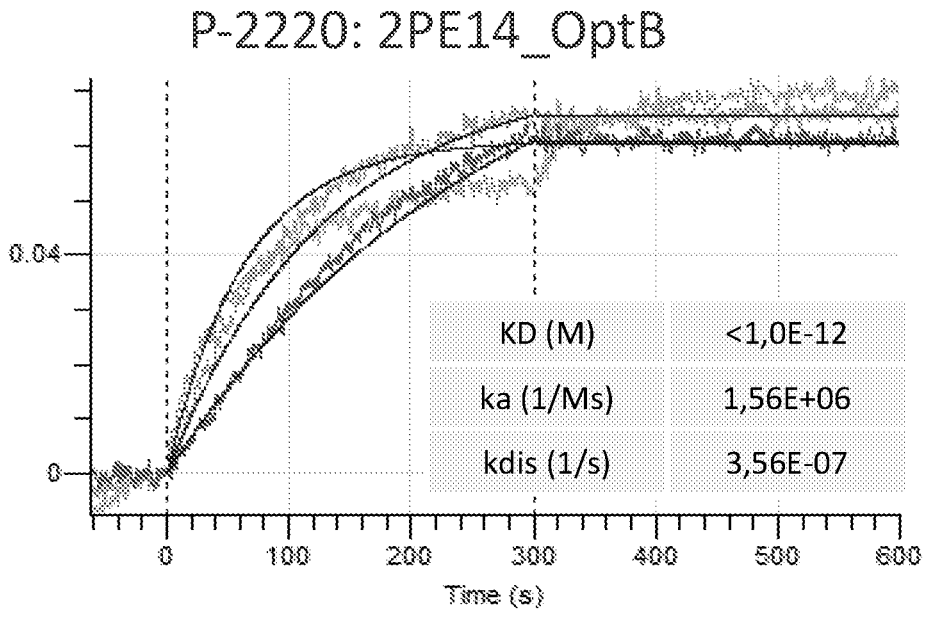
Figure 24F:
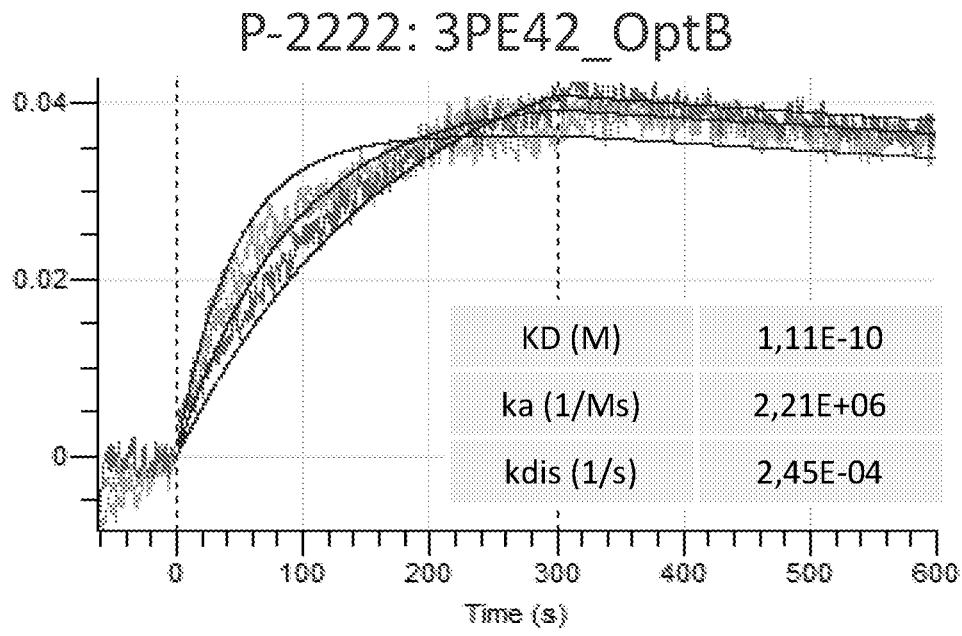
Figure 24G:
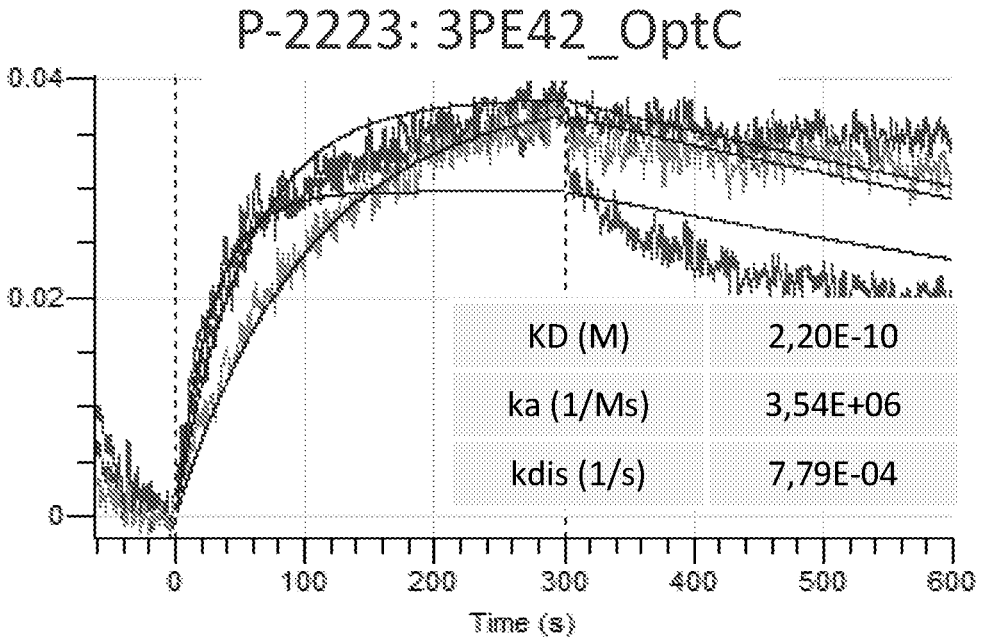
Figure 24H:
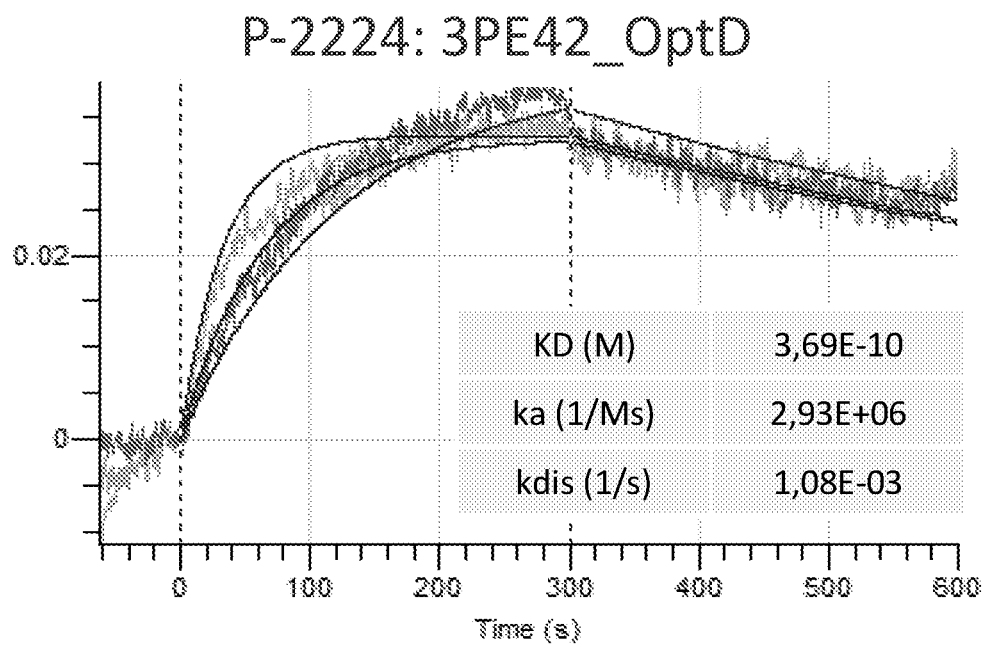

A selection of 11 VHHs were studied in more detail for binding to human, mouse and cynomolgus FAP as described above. In brief, differently transfected HEK293T cells were incubated with a serial dilution of metal-affinity based purified VHHs for two hours. Binding was detected using an FITC-coupled anti-His Ab (Genscript) in FACS. Surprisingly, the VHHs were cross-reactive to human, mouse and cynomolgus. Data showing VHH cross-reactive to human, mouse and cynomolgus FAP are summarized in FIG. 2. The data for 2PE14 is shown in FIG. 2A, the data for 2PE17 is shown in FIG. 2B, the data for 2PE36 is shown in FIG. 2C, the data for 2PE40 is shown in FIG. 2D, the data for 2PE42 is shown in FIG. 2E, the data for 2PE44 is shown in FIG. 2F, the data for 3PE12 is shown in FIG. 2G, the data for 3PE42 is shown in FIG. 2H, the data for 3PE57 is shown in FIG. 2I, the data for 3PE93 is shown in FIG. 2J, and the data for 3PE94 is shown in FIG. 2K

Example 3. Human FAP ActaFerons (AFNs)

Based on affinity for human, mouse and cynomolgus monkey FAP, three FAP VHH were selected for evaluation in a heterodimeric, 'knob-in-hole Fc' AFN context: 2PE14, 3PE12 and 3PE42. To this end, FAP VHH sequences were, via the flexible 20*GGS-linker and in the pcDNA3.4 expression vector, fused to the human IgG1 Fc sequence containing the L234A_L235A_K322Q effector mutations and the 'hole' modifications Y349C_T366S_L368A_Y407V (see sequences below). Second AFN partner, also cloned in the pcDNA3.4 vector, consists of the fusion between the human IgG1 Fc sequence containing the L234A_L235A_K322Q effector mutations and the 'knob' modifications S354C_T366W and the hIFNa2 sequence with the AFN mutation R149A and the O-glycosylation mutation T106E.

To produce the heterodimeric, 'knob-in-hole' AFNs, a combination of both plasmids was transfected in ExpiCHO cells (THERMOFISHER) according to the manufacturers instructions. Seven days post transfection, recombinant proteins were purified using protein A spin plates (THERMOFISHER), quantified and purity tested using SDS-PAGE.

Biological activity of resulting AFNs (2PE14-AFN, 3PE12-AFN, and 3PE42-AFN) was measured on parental HL116 cells (an IFN responsive cell-line stably transfected with a p6-16 luciferase reporter) and the derived, stably transfected HL116-hFAP cells. Cells were seeded overnight and stimulated for 6 hours with a serial dilution FAP VHH AFN. Luciferase activity was measured on an EnSight Multimode Plate Reader (Perkin Elmer). Data in FIG. 3 clearly illustrate that FAP targeting results in IFN-like signalling in HL116-hFAP cells, while in parental HL116 cells hardly any reporter activation could be observed. Of note, HL116 and HL116-hFAP cells are comparable sensitive to wild type IFNa2.

The structure for 2PE14 AFN:

hFAP   VHH   2PE14—20*GGS—hIgG1 Fc_L234A_L235A_K322Q_Y349C_T366S_L368A_Y407V

Amino acid sequence for 2PE14 AFN (the amino acid sequence for hFAP VHH 2PE14 is shown in bold letters, the amino acid sequence for 20*GGS linker is shown in italicized letters, and the amino acid sequence for hIgG1 Fc_L234A_L235A_K322Q_Y349C_T366S_L368A_Y407V is shown in underlined letters):

(SEQ ID NO: 1038)
QVQLQESGGGLVQPGGSLRLSCAASGSTFSINAVAWYRQAPGKRRELVAGI

SGGGVTNYPDSVKGRFTISRDNAKNTVYLQMSSLKPEDTAVYYCNLWPPRA

SPGGRVYWGQGTQVTVSSGGSGGSGGSGGSGGSGGSGGSGGSGGSGGSGGS

GGSGGSGGSGGSGGSGGSGGSGGSGGSDKTHTCPPCPAPEAAGGPSVFLFP

PKPKDTLMISRTPEVTCVVVDVSHEDPEVKFNWYVDGVEVHNAKTKPREEQ

YNSTYRWVSVLTVLHQDWLNGKEYKCQVSNKALPAPIEKTISKAKGQPREP

QVCTLPPSRDELTKNQVSLSCAVKGFYPSDIAVEWESNGQPENNYKTTPPV

LDSDGSFFLVSKLTVDKSRWQQGNVFSCSVMHEALHNHYTQKSLSLSPGK

The structure for 3PE12 AFN:

hFAP   VHH   3PE12—20*GGS—hIgG1 Fc_L234A_L235A_K322Q_Y349C_T366S_L368A_Y407V

Amino acid sequence for 3PE12 AFN (the amino acid sequence for hFAP VHH 3PE12 is shown in bold letters, the amino acid sequence for 20*GGS linker is shown in italicized letters, and the amino acid sequence for hIgG1 Fc_L234A_L235A_K322Q_Y349C_T366S_L368A_Y407V is shown in underlined letters):

(SEQ ID NO: 1039)
QVQLQESGGGLVQPGGSLRLSCAASGSTFSGNAMAWYRQAPGKRRELVAGI

SGGGVTNYPDSVKGRFTISRDNAKNTVYLQMSSLKPEDTAVYYCNLWPPRV

SPGGGVYWGQGTQVTVSSGGSGGSGGSGGSGGSGGSGGSGGSGGSGGSGGS

-continued

*GGSGGSGSGGSGGSGGSGGSGGSGGS*<u>DKTHTCPPCPAPEAAGGPSVFLFPP</u>

<u>KPKDTLMISRTPEVTCVVVDVSHEDPEVKFNWYVDGVEVHNAKTKPREEQY</u>

<u>NSTYRWVSVLTVLHQDWLNGKEYKCQVSNKALPAPIEKTISKAKGQPREPQ</u>

<u>VCTLPPSRDELTKNQVSLSCAVKGFYPSDIAVEWESNGQPENNYKTTPPVL</u>

<u>DSDGSFFLVSKLTVDKSRWQQGNVFSCSVMHEALHNHYTQKSLSLSPGK</u>

The structure for 3PE42 AFN:
> hFAP VHH 3PE42-20*GGS—hIgG1 Fc_L234A_L235A_K322Q_Y349C_T366S_L368A_Y407V Amino acid sequence for 3PE12 AFN (the amino acid sequence for hFAP VHH 3PE42 is shown in bold letters, the amino acid sequence for 20*GGS linker is shown in italicized letters, and the amino acid sequence for hIgG1 Fc_L234A_L235A_K322Q_Y349C_T366S_L368A_Y407V is shown in underlined letters):

(SEQ ID NO: 1040)
QVQLQESGGGLVQPGESLRLSCAVSGSTSSMNAMAWYRQAPGKRRELVAGI

SGGGATNYPDSVKGRFTISRDNAKNTVYLQMSSLKPEDTAVYYCNLWPPRA

SPGGGVYWGQGTQVTVSS*GGSGGSGGSGGSGGSGGSGGSGGSGGSGGSGGS*

*GGSGGSGGSGGSGGSGGSGGSGGSGGS*<u>DKTHTCPPCPAPEAAGGPSVFLFPP</u>

<u>PKPKDTLMISRTPEVTCVVVDVSHEDPEVKFNWYVDGVEVHNAKTKPREEQ</u>

<u>YNSTYRWVSVLTVLHQDWLNGKEYKCQVSNKALPAPIEKTISKAKGQPREP</u>

<u>QVCTLPPSRDELTKNQVSLSCAVKGFYPSDIAVEWESNGQPENNYKTTPPV</u>

<u>LDSDGSFFLVSKLTVDKSRWQQGNVFSCSVMHEALHNHYTQKSLSLSPGK</u>

> hIgG1 Fc_L234A_L235A_K322Q_S354C_T366W—20*GGS—hIFNa2 T106E R149A (SEQ ID NO: 1041)
DKTHTCPPCPAPEAAGGPSVFLFPPPKPKDTLMISRTPEVTCVVVDVSHEDPE

VKFNWYVDGVEVHNAKTKPREEQYNSTYRVVSVLTVLHQDWLNGKEYKCQV

-continued

SNKALPAPIEKTISKAKGQPREPQVYTLPPCRDELTKNQVSLWCLVKGFYP

SDIAVEWESNGQPENNYKTTPPVLDSDGSFFLYSKLTVDKSRWQQGNVFSC

SVMHEALHNHYTQKSLSLSPGK*GGSGGSGGSGGSGGSGGSGGSGGSGGSGGSGG*

*SGGSGGSGGSGGSGGSGGSGGSGGSGGSGGS*CDLPQTHSLGSRRTLMLLAQ

MRKISLFSCLKDRHDFGFPQEEFGNQFQKAETIPVLHEMIQQIFNLFSTKD

SSAAWDETLLDKFYTELYQQLNDLEACVIQGVGVEETPLMKEDSILAVRKY

FQRITLYLKEKKYSPCAWEVVRAEIMASFSLSTNLQESLRSKE

Example 4. Humanization of FAP VHH Sequences

In this example, the sequence of two FAP VHHs 2PE14 and 3PE42 are humanized. Humanization is evaluated with four 'opt' variants (sequences P-1902 to P-1905) which contain a combination of the following mutations: Q1D, Q5V, P60A, A74S, S82N, K83R, and Q108L. Further, both VHHs contain a deamidation site (N32) in CDR1, and VHH 3PE42 an extra oxidation motif (M31), also in CDR1. Both sequence instabilities were removed by individual mutation to any other amino acid (except C or P; sequences P-1906 to P-1922 for the deamidation, and P-1924 to P-1941 for the oxidation motif). Sequences, ordered with Twist Biosciences, were cloned with a C-terminal His-tag in the pET28 vector and transformed in BL21 cells. VHHs were expressed upon overnight IPTG stimulation and purified from the periplasmic extracts using HisPur Cobalt Spin Plates (ThermoFisher) according to the manufacturers guidelines. Affinity of the resulting VHHs for FAP was measured using the bio-layer interferometry (BLI) technology on an Octet RED96 instrument (ForteBio).

In brief, recombinant FAP protein (BioLegend) was biotinylated using the Antibody Biotinylation Kit for IP (Pierce) and used to load Streptavidin sensors (ForteBio). Association and dissociation of three concentrations (10, 5 and 2.5 nM) FAP VHH were monitored and used to calculate the association and dissociation constants and hence the affinity. Results for the FAP VHH variants are summarized in Table 7. Preferred mutations of N32 include F, Q, R and W. Preferred mutations for M31 include A, D, K, L, N, Q, R, S and W.

TABLE 7

| Variation | P-number | Variant | KD (M) |
|---|---|---|---|
| Wild type | P-1901 | pET28 PelB-2PE14 | 6.67E−10 |
| Humanisation | P-1902 | pET28 PelB-2PE14_opt1 (Q1D_Q5V_A74S_K83R_Q108L) | 9.51E−11 |
| | P-1903 | pET28 PelB-2PE14_opt2 (idem + P60A) | 2.26E−09 |
| | P-1904 | pET28 PelB-2PE14_opt3 (idem + S82N) | 6.53E−10 |
| | P-1905 | pET28 PelB-2PE14_opt4 (idem + P60A_S82N) | 3.76E−09 |
| Randomisation of NA | P-1906 | pET28 PelB-2PE14_N32A | 3.56E−09 |
| deamidation motif in | P-1907 | pET28 PelB-2PE14_N32D | 1.08E−08 |
| 2PE14 | P-1908 | pET28 PelB-2PE14_N32E | 1.09E−09 |
| | P-1909 | pET28 PelB-2PE14_N32F | 4.68E−10 |
| | P-1910 | pET28 PelB-2PE14_N32G | 4.62E−09 |
| | P-1911 | pET28 PelB-2PE14_N32H | 3.69E−09 |
| | P-1912 | pET28 PelB-2PE14_N32I | 1.68E−08 |
| | P-1913 | pET28 PelB-2PE14_N32K | 2.67E−09 |
| | P-1914 | pET28 PelB-2PE14_N32L | 1.25E−09 |
| | P-1915 | pET28 PelB-2PE14_N32P | 1.17E−09 |
| | P-1916 | pET28 PelB-2PE14_N32Q | 3.86E−10 |
| | P-1917 | pET28 PelB-2PE14_N32R | 3.17E−10 |
| | P-1918 | pET28 PelB-2PE14_N32S | 5.56E−07 |
| | P-1919 | pET28 PelB-2PE14_N32T | 4.11E−09 |
| | P-1920 | pET28 PelB-2PE14_N32V | 1.00E−07 |
| | P-1921 | pET28 PelB-2PE14_N32W | 2.21E−10 |
| | P-1922 | pET28 PelB-2PE14_N32Y | 1.45E−08 |

TABLE 7-continued

| Variation | P-number | Variant | KD (M) |
|---|---|---|---|
| Wild type | P-1923 | pET28 PelB-3PE42 | 5.88E−10 |
| Randomisation of M | P-1924 | pET28 PelB-3PE42_M42A | 8.89E−11 |
| oxidation motif in | P-1925 | pET28 PelB-3PE42_M42D | 1.65E−10 |
| 3PE42 | P-1926 | pET28 PelB-3PE42_M42E | 1.85E−09 |
| | P-1927 | pET28 PelB-3PE42_M42F | 1.17E−09 |
| | P-1928 | pET28 PelB-3PE42_M42G | 4.02E−09 |
| | P-1929 | pET28 PelB-3PE42_M42H | 1.12E−09 |
| | P-1930 | pET28 PelB-3PE42_M42I | 2.87E−09 |
| | P-1931 | pET28 PelB-3PE42_M42K | 8.51E−10 |
| | P-1932 | pET28 PelB-3PE42_M42L | 8.72E−10 |
| | P-1933 | pET28 PelB-3PE42_M42N | 5.67E−10 |
| | P-1934 | pET28 PelB-3PE42_M42P | 1.34E−09 |
| | P-1935 | pET28 PelB-3PE42_M42Q | 2.14E−10 |
| | P-1936 | pET28 PelB-3PE42_M42R | 2.76E−11 |
| | P-1937 | pET28 PelB-3PE42_M42S | 6.13E−10 |
| | P-1938 | pET28 PelB-3PE42_M42T | 1.16E−09 |
| | P-1939 | pET28 PelB-3PE42_M42V | 2.45E−09 |
| | P-1940 | pET28 PelB-3PE42_M42W | 9.45E−11 |
| | P-1941 | pET28 PelB-3PE42_M42Y | 1.12E−09 |

Sequences:

• P-1901: 2PE14
QVQLQESGGGLVQPGGSLRLSCAASGSTFSINAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1045)

• P-1902: 2PE14_opt1 (Q1D_Q5V_A74S_K83R_Q108L; bold letters show the mutation)
DVQLVESGGGLVQPGGSLRLSCAASGSTFSINAVAWYRQAPGKRRELVAGISGGGVTNYPDSVKGRFTISRDNSKNTV
YLQMSSLRPEDTAVYYCNLWPPRASPGGRVYWGQGTLVTVSS (SEQ ID NO: 1046)

• P-1903: 2PE14_opt2 (Q1D_Q5V_P60A_A74S_K83R_Q108L; bold letters show the mutation)
DVQLVESGGGLVQPGGSLRLSCAASGSTFSINAVAWYRQAPGKRRELVAGISGGGVTNYADSVKGRFTISRDNSKNT
VYLQMSSLRPEDTAVYYCNLWPPRASPGGRVYWGQGTLVTVSS (SEQ ID NO: 1047)

• P-1904: 2PE14_opt3 (Q1 D_Q5V_A74S_S82N_K83R_Q108L; bold letters show the mutation)
DVQLVESGGGLVQPGGSLRLSCAASGSTFSINAVAWYRQAPGKRRELVAGISGGGVTNYPDSVKGRFTISRDNSKNTV
YLQMNSLRPEDTAVYYCNLWPPRASPGGRVYWGQGTLVTVSS (SEQ ID NO: 1048)

• P-1905: 2PE14_opt4 (Q1D_Q5V_P60A_A74S_S82N_K83R_Q108L; bold letters show the mutation)
DVQLVESGGGLVQPGGSLRLSCAASGSTFSINAVAWYRQAPGKRRELVAGISGGGVTNYADSVKGRFTISRDNSKNT
VYLQMNSLRPEDTAVYYCNLWPPRASPGGRVYWGQGTLVTVSS (SEQ ID NO: 1049)

• P-1906: 2PE14_N32A (bold letters show the mutation)
QVQLQESGGGLVQPGGSLRLSCAASGSTFSIAAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1050)

• P-1907: 2PE14_N32D (bold letters show the mutation)
QVQLQESGGGLVQPGGSLRLSCAASGSTFSIDAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1051)

• P-1908: 2PE14_N32E (bold letters show the mutation)
QVQLQESGGGLVQPGGSLRLSCAASGSTFSIEAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1052)

• P-1909: 2PE14_N32F (bold letters show the mutation)
QVQLQESGGGLVQPGGSLRLSCAASGSTFSIFAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1053)

• P-1910: 2PE14_N32G (bold letters show the mutation)
• QVQLQESGGGLVQPGGSLRLSCAASGSTFSIGAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1054)

• P-1911: 2PE14_N32H (bold letters show the mutation)
QVQLQESGGGLVQPGGSLRLSCAASGSTFSIHAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1055)

• P-1912: 2PE14_N32I (bold letters show the mutation)
QVQLQESGGGLVQPGGSLRLSCAASGSTFSIIAVAWYRQAPGKRRELVAGISGGGVTNYPDSVKGRFTISRDNAKNTV
YLQMSSLKPEDTAVYYCNLWPPRASPGGRVYWGQGTQVTVSS (SEQ ID NO: 1056)

• P-1913: 2PE14_N32K (bold letters show the mutation)
QVQLQESGGGLVQPGGSLRLSCAASGSTFSIKAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1057)

Sequences:

• P-1914: 2PE14_N32L (bold letters show the mutation)
QVQLQESGGGLVQPGGSLRLSCAASGSTFSILAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1058)

• P-1915: 2PE14_N32P (bold letters show the mutation)
QVQLQESGGGLVQPGGSLRLSCAASGSTFSIPAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1059)

• P-1916: 2PE14_N32Q (bold letters show the mutation)
QVQLQESGGGLVQPGGSLRLSCAASGSTFSIQAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1060)

• P-1917: 2PE14_N32R (bold letters show the mutation)
QVQLQESGGGLVQPGGSLRLSCAASGSTFSIRAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1061)

• P-1918: 2PE14_N32S (bold letters show the mutation)
QVQLQESGGGLVQPGGSLRLSCAASGSTFSISAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1062)

• P-1919: 2PE14_N32T (bold letters show the mutation)
QVQLQESGGGLVQPGGSLRLSCAASGSTFSITAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1063)

• P-1920: 2PE14_N32V (bold letters show the mutation)
QVQLQESGGGLVQPGGSLRLSCAASGSTFSIVAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1064)

• P-1921: 2PE14_N32W (bold letters show the mutation)
QVQLQESGGGLVQPGGSLRLSCAASGSTFSIWAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1065)

• P-1922: 2PE14_N32Y (bold letters show the mutation)
QVQLQESGGGLVQPGGSLRLSCAASGSTFSIYAVAWYRQAPGKRRELVAGISGGGVTNYPDSVKGRFTISRDNAKNT
VYLQMSSLKPEDTAVYYCNLWPPRASPGGRVYWGQGTQVTVSS (SEQ ID NO: 1066)

• P-1923: 3PE42 (bold letters show the mutation)
QVQLQESGGGLVQPGESLRLSCAVSGSTSSMNAMAWYRQAPGKRRELVAGISGGGATNYPDSVKGRFTISRDNAKN
TVYLQMSSLKPEDTAVYYCNLWPPRASPGGGVYWGQGTQVTVSS (SEQ ID NO: 1067)

• P-1924: 3PE42_M31A (bold letters show the mutation)
QVQLQESGGGLVQPGESLRLSCAVSGSTSSANAMAWYRQAPGKRRELVAGISGGGATNYPDSVKGRFTISRDNAKN
TVYLQMSSLKPEDTAVYYCNLWPPRASPGGGVYWGQGTQVTVSS (SEQ ID NO: 1068)

• P-1925: 3PE42_M31D (bold letters show the mutation)
QVQLQESGGGLVQPGESLRLSCAVSGSTSSDNAMAWYRQAPGKRRELVAGISGGGATNYPDSVKGRFTISRDNAKN
TVYLQMSSLKPEDTAVYYCNLWPPRASPGGGVYWGQGTQVTVSS (SEQ ID NO: 1069)

• P-1926: 3PE42_M31E (bold letters show the mutation)
QVQLQESGGGLVQPGESLRLSCAVSGSTSSENAMAWYRQAPGKRRELVAGISGGGATNYPDSVKGRFTISRDNAKNT
VYLQMSSLKPEDTAVYYCNLWPPRASPGGGVYWGQGTQVTVSS (SEQ ID NO: 1070)

• P-1927: 3PE42_M31F (bold letters show the mutation)
QVQLQESGGGLVQPGESLRLSCAVSGSTSSFNAMAWYRQAPGKRRELVAGISGGGATNYPDSVKGRFTISRDNAKNT
VYLQMSSLKPEDTAVYYCNLWPPRASPGGGVYWGQGTQVTVSS (SEQ ID NO: 1071)

• P-1928: 3PE42_M31G (bold letters show the mutation)
QVQLQESGGGLVQPGESLRLSCAVSGSTSSGNAMAWYRQAPGKRRELVAGISGGGATNYPDSVKGRFTISRDNAKN
TVYLQMSSLKPEDTAVYYCNLWPPRASPGGGVYWGQGTQVTVSS (SEQ ID NO: 1072)

• P-1929: 3PE42_M31H (bold letters show the mutation)
QVQLQESGGGLVQPGESLRLSCAVSGSTSSHNAMAWYRQAPGKRRELVAGISGGGATNYPDSVKGRFTISRDNAKN
TVYLQMSSLKPEDTAVYYCNLWPPRASPGGGVYWGQGTQVTVSS (SEQ ID NO: 1073)

• P-1930: 3PE42_M31I (bold letters show the mutation)
QVQLQESGGGLVQPGESLRLSCAVSGSTSSINAMAWYRQAPGKRRELVAGISGGGATNYPDSVKGRFTISRDNAKNT
VYLQMSSLKPEDTAVYYCNLWPPRASPGGGVYWGQGTQVTVSS (SEQ ID NO: 1074)

• P-1931: 3PE42_M31K (bold letters show the mutation)
QVQLQESGGGLVQPGESLRLSCAVSGSTSSKNAMAWYRQAPGKRRELVAGISGGGATNYPDSVKGRFTISRDNAKN
TVYLQMSSLKPEDTAVYYCNLWPPRASPGGGVYWGQGTQVTVSS (SEQ ID NO: 1075)

• P-1932: 3PE42_M31L (bold letters show the mutation)
QVQLQESGGGLVQPGESLRLSCAVSGSTSSLNAMAWYRQAPGKRRELVAGISGGGATNYPDSVKGRFTISRDNAKNT
VYLQMSSLKPEDTAVYYCNLWPPRASPGGGVYWGQGTQVTVSS (SEQ ID NO: 1076)

-continued

---

Sequences:

---

```
• P-1933: 3PE42_M31N (bold letters show the mutation)
QVQLQESGGGLVQPGESLRLSCAVSGSTSSNNAMAWYRQAPGKRRELVAGISGGGATNYPDSVKGRFTISRDNAKN
TVYLQMSSLKPEDTAVYYCNLWPPRASPGGGVYWGQGTQVTVSS (SEQ ID NO: 1077)

• P-1934: 3PE42_M31P (bold letters show the mutation)
QVQLQESGGGLVQPGESLRLSCAVSGSTSSPNAMAWYRQAPGKRRELVAGISGGGATNYPDSVKGRFTISRDNAKNT
VYLQMSSLKPEDTAVYYCNLWPPRASPGGGVYWGQGTQVTVSS (SEQ ID NO: 1078)

• P-1935: 3PE42_M31Q (bold letters show the mutation)
QVQLQESGGGLVQPGESLRLSCAVSGSTSSQNAMAWYRQAPGKRRELVAGISGGGATNYPDSVKGRFTISRDNAKN
TVYLQMSSLKPEDTAVYYCNLWPPRASPGGGVYWGQGTQVTVSS (SEQ ID NO: 1079)

• P-1936: 3PE42_M31R (bold letters show the mutation)
QVQLQESGGGLVQPGESLRLSCAVSGSTSSRNAMAWYRQAPGKRRELVAGISGGGATNYPDSVKGRFTISRDNAKN
TVYLQMSSLKPEDTAVYYCNLWPPRASPGGGVYWGQGTQVTVSS (SEQ ID NO: 1080)

• P-1937: 3PE42_M31S (bold letters show the mutation)
QVQLQESGGGLVQPGESLRLSCAVSGSTSSSNAMAWYRQAPGKRRELVAGISGGGATNYPDSVKGRFTISRDNAKNT
VYLQMSSLKPEDTAVYYCNLWPPRASPGGGVYWGQGTQVTVSS (SEQ ID NO: 1081)

• P-1938: 3PE42_M31T (bold letters show the mutation)
QVQLQESGGGLVQPGESLRLSCAVSGSTSSTNAMAWYRQAPGKRRELVAGISGGGATNYPDSVKGRFTISRDNAKNT
VYLQMSSLKPEDTAVYYCNLWPPRASPGGGVYWGQGTQVTVSS (SEQ ID NO: 1082)

• P-1939: 3PE42_M31V (bold letters show the mutation)
QVQLQESGGGLVQPGESLRLSCAVSGSTSSVNAMAWYRQAPGKRRELVAGISGGGATNYPDSVKGRFTISRDNAKNT
VYLQMSSLKPEDTAVYYCNLWPPRASPGGGVYWGQGTQVTVSS (SEQ ID NO: 1083)

• P-1940: 3PE42_M31W (bold letters show the mutation)
QVQLQESGGGLVQPGESLRLSCAVSGSTSSWNAMAWYRQAPGKRRELVAGISGGGATNYPDSVKGRFTISRDNAKN
TVYLQMSSLKPEDTAVYYCNLWPPRASPGGGVYWGQGTQVTVSS (SEQ ID NO: 1084)

• P-1941: 3PE42_M31Y (bold letters show the mutation)
QVQLQESGGGLVQPGESLRLSCAVSGSTSSYNAMAWYRQAPGKRRELVAGISGGGATNYPDSVKGRFTISRDNAKNT
VYLQMSSLKPEDTAVYYCNLWPPRASPGGGVYWGQGTQVTVSS (SEQ ID NO: 1085)
```

---

Example 5. FAP VHH Variants

In this example, the observations from the humanization (Example 4) were combined to generate six additional VHH variants. In these variants, we combined the humanization mutations (Q1D_Q5V_A74S_K83R_Q108L, with and without S82N), the N32W deamidation mutation, and, in the case of 3PE42, oxidation mutations M42A or M42D. Variants were produced and purified, and affinity measured as described above. Data in FIG. 24 illustrates that combination of these mutations for 2PE14 has no major impact on affinity (2PE14_OptA) or even results in a major affinity increase (2PE14_OptB). For 3PE42 the combination of mutations as in 3PE42_OptB has no major impact on affinity.

---

Sequences:

---

```
• P-1901: 2PE14
QVQLQESGGGLVQPGGSLRLSCAASGSTFSINAVAWYRQAPGKRRELVAGISGGGVTNYPDSVKGRFTISRDNAKNTVYL
QMSSLKPEDTAVYYCNLWPPRASPGGRVYWGQGTQVTVSS (SEQ ID NO: 1045)

• P-2219: 2PE14_OptA (Q1D_Q5V_N32W_A74S_K83R_Q108L)
DVQLVESGGGLVQPGGSLRLSCAASGSTFSIWAVAWYRQAPGKRRELVAGISGGGVTNYPDSVKGRFTISRDNSKNTVYL
QMSSLRPEDTAVYYCNLWPPRASPGGRVYWGQGTLVTVSS (SEQ ID NO: 1086)

• P-2220: 2PE14_OptB (Q1D_Q5V_N32W_A74S_S82N_K83R_Q108L)
DVQLVESGGGLVQPGGSLRLSCAASGSTFSIWAVAWYRQAPGKRRELVAGISGGGVTNYPDSVKGRFTISRDNSKNTVYL
QMNSLRPEDTAVYYCNLWPPRASPGGRVYWGQGTLVTVSS (SEQ ID NO: 1087)

• P-1923: 3PE42
QVQLQESGGGLVQPGESLRLSCAVSGSTSSMNAMAWYRQAPGKRRELVAGISGGGATNYPDSVKGRFTISRDNAKNTVY
LQMSSLKPEDTAVYYCNLWPPRASPGGGVYWGQGTQVTVSS (SEQ ID NO: 1088)

• P-2221: 3PE42_OptA (Q1D_Q5V_M31A_N32W_A74S_K83R_Q108L)
DVQLVESGGGLVQPGGSLRLSCAASGSTSSAWAMAWYRQAPGKRRELVAGISGGGATNYPDSVKGRFTISRDNSKNTVY
LQMSSLRPEDTAVYYCNLWPPRASPGGGVYWGQGTLVTVSS (SEQ ID NO: 1089)

• P-2222: 3PE42_OptB (Q1D_Q5V_M31D_N32W_A74S_K83R_Q108L)
DVQLVESGGGLVQPGGSLRLSCAASGSTSSDWAMAWYRQAPGKRRELVAGISGGGATNYPDSVKGRFTISRDNSKNTVY
LQMSSLRPEDTAVYYCNLWPPRASPGGGVYWGQGTLVTVSS (SEQ ID NO: 1090)
```

-continued

Sequences:

• P-2223: 3PE42_OptC (Q1D_Q5V_M31A_N32W_A74S_S82N_K83R_Q108L)
DVQLVESGGGLVQPGGSLRLSCAASGSTSSAWAMAWYRQAPGKRRELVAGISGGGATNYPDSVKGRFTISRDNSKNTVY
LQMNSLRPEDTAVYYCNLWPPRASPGGGVYWGQGTLVTVSS (SEQ ID NO: 1091)

• P-2224: 3PE42_OptD (Q1D_Q5V_M31D_N32W_A74S_S82N_K83R_Q108L)
DVQLVESGGGLVQPGGSLRLSCAASGSTSSDWAMAWYRQAPGKRRELVAGISGGGATNYPDSVKGRFTISRDNSKNTVY
LQMNSLRPEDTAVYYCNLWPPRASPGGGVYWGQGTLVTVSS (SEQ ID NO: 1092)

EQUIVALENTS

While the present technology has been described in connection with specific embodiments thereof, it will be understood that it is capable of further modifications and this application is intended to cover any variations, uses, or adaptations of the present technology following, in general, the principles of the present technology and including such departures from the present disclosure as come within known or customary practice within the art to which the present technology pertains and as may be applied to the essential features hereinbefore set forth and as follows in the scope of the appended claims.

Those skilled in the art will recognize, or be able to ascertain, using no more than routine experimentation, numerous equivalents to the specific embodiments described specifically herein. Such equivalents are intended to be encompassed in the scope of the following claims.

INCORPORATION BY REFERENCE

All patents and publications referenced herein are hereby incorporated by reference in their entireties.

SEQUENCE LISTING (1129 sequences)

SEQ ID NO: 1 - protein, 760 aa, Artificial Sequence [sequence omitted]

SEQ ID NO: 2 - protein, 120 aa, Artificial Sequence
  Synthetic (2PE2)
QVQLQESGGGSVQVGGSLRLSCADSGSTFTINAMGWYRQAPGKRRDWVAGITSSGVTQYPDSVKGRFTISRDNAKNTVYLQMNSLKPEDTAVYYCNLWPPRASPSGRIYWGQGTQVTVSS

SEQ ID NO: 3 - protein, 120 aa, Artificial Sequence
  Synthetic
QVQLQESGGGLVQPGGSLRLSCAASESTFSINAVAWYRQAPGKRRELVAGISGGGVTSYPDSVKGRFTISRDNAKNIVYLQMSSLKPEDTAVYYCNLWPPRASPGGRVYWGQGTQVTVSS

SEQ ID NO: 4 - protein, 120 aa, Artificial Sequence
  Synthetic
QVQLQESGGGLVHAGGSLRLSCADSGSTFSVNAVGWYRQAPGKRRDWVAGITSDGVTNYPDSVKGRFTISRDNAKNTVYLQMNSLKPEDTAVYYCNLWPPRASPSGRIYWGQGTQVTVSS

SEQ ID NO: 5 - protein, 120 aa, Artificial Sequence
  Synthetic
QVQLQESGGGLVQVGGSLRLSCAASGSTFILNAMAWYRQAPGNRRELVAGISSGGDTNYPDSVKGRFTISRDNANNIVYLQMNSLKLEDTAVYYCNLWPPRASPSGRVYWGQGTQVTVSS

SEQ ID NO: 6 - protein, 120 aa, Artificial Sequence
  Synthetic
QVQLQESGGGLVQPGGSLRLSCAASGSTFSINAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 7 - protein, 120 aa, Artificial Sequence
  Synthetic
QVQLQESGGGLVQSGGSLRLSCAASGSTFSINAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 8 - protein, 119 aa, Artificial Sequence
  Synthetic
QVQLQESGGGLVQPGGSLRLSCADSGSTFTINAMAWYRQAPGKRRELVAGISGGVTNYPDSVKGRFTISRDNAKNTVYLQMSSLKPEDTAVYYCNLWPPRASPDGRVYWGQGTQVTVSS

SEQ ID NO: 9 - protein, 120 aa, Artificial Sequence
  Synthetic
QVQLQESGGGLVQPGGSLRLSCAASESTFSINAVAWYRQAPGKRRELVAGISGGGVTNYPDSVKGRFTVSRDNAKNIVYLQMSSLKPEDTAVYYCNLWPPRASPGGRVYWGQGTQVTVSS

SEQ ID NO: 10 - protein, 121 aa, Artificial Sequence
  Synthetic
QVQLQESGGGLVQPGGSLRLSCADSGSTFSINNAMGWYRQAPGKRRDWVAGITSSGVTNYPDSVKGRFTISRDNAKNTVYLQMNSLKPEDTAVYYCNLWPPRASPSGTIYWGQGTQVTVSS

SEQ ID NO: 11 - protein, 120 aa, Artificial Sequence
  Synthetic
QVQLQESGGGLVQVGGSLRLSCAASGSSFIINAMGWYRQAPGKRRELVAGISSDGATHYPDSVKGRFTISRDNAKNIVYLQMNSLKPEDTAVYYCNLWPPRASPSGRVYWGQGTQVTVSS

SEQ ID NO: 12 - protein, 120 aa, Artificial Sequence
  Synthetic
QVQLQESGGGLVQPGGSLRLSCAASGSISSINAMAWYRQAPGKRRELVAGIDGGGVTNYPDSVKGRFTISRDNAKNTVYLQMSSLKPEDTAVYYCNLWPPRASPGGRVYWGQGTQVTVSS

SEQ ID NO: 13 - protein, 121 aa, Artificial Sequence
  Synthetic
QVQLQESGGGLVQIGGSLRLSCADSGSTFSINNAMGWYRQAPGKRRDWVAGITSSGVTNYPDSVKGRFTISRDNAKNTVYLQMNSLKPEDTAVYYCNLWPPRASPSGTIYWGQGTQVTVSS

SEQ ID NO: 14 - protein, 120 aa, Artificial Sequence
  Synthetic
QVQLQESGGGLVQPGGSLRLSCAASGSTSSINAMAWYRQAPGKRRELVAGIDGGGVTNYPDSVKGRFTISRDNAKNTVYLQMSSLKPEDTAVYYCNLWPPRASPGGRVYWGQGTQVTVSS

SEQ ID NO: 15 - protein, 121 aa, Artificial Sequence
  Synthetic
QVQLQESGGGLVQVGGSLRLSCADSGSTFSINNAMGWYRQAPGKRRDWVAGITSSGVTNYPDSVKGRFTISRDNAKNTVYLQMNSLKPEDTAVYYCNLWPPRASPSGRIYWGQGTQVTVSS

SEQ ID NO: 16 - protein, 120 aa, Artificial Sequence
  Synthetic
QVQLQESGGGLVQVGGSLRLSCAASGSTFSINAMGWYRQAPGKRRELVAGISSDDITYYPDSVKGRFTISRDNAKNTVYLQMNSLKPEDTAVYYCNLWPPRASPSGRGYWGQGTQVTVSS

SEQ ID NO: 17 - protein, 120 aa, Artificial Sequence
  Synthetic
QVQLQESGGGLVQPGGSLRLSCADSGSTFSINSMGWYRQAPGKRRDWVAGITTDGITKYPDSLKGRFTISRDNAKNTVYLQMNSLKPEDTAVYYCNLWPPRASPSGRLYWGQGTQVTVSS

SEQ ID NO: 18 - protein, 120 aa, Artificial Sequence
  Synthetic
QVQLQESGGGLVQPGGSLRLSCAASGSTFSINAVAWYRQAPGKRRELVAGISGGGVTNYPDSVKGRFTISRDNAKNTVYLQMSSLKPEDTAVYYCNLWPPRASPDGRVYWGQGTQVTVSS

SEQ ID NO: 19 - protein, 120 aa, Artificial Sequence
  Synthetic
  misc_feature (39)..(39): Xaa can be any naturally occurring amino acid
QVQLQESGGGLVQAGESLRLSCAASGSTFTINAMGWYRXAPGKRRDWVAGITSSGVTQYPDSVKGRFTISRDNAKNTVYLQMNSLKPEDTAVYYCNLWPPRASPSGRIYWGQGTQVTVSS

SEQ ID NO: 20 - protein, 120 aa, Artificial Sequence
  Synthetic
QVQLQESGGGLVQVGGSLRLSCADSGSTFSVNAVGWYRQAPGKRRDWVAGITSDGVTNYPDSVKGRFTISRDNAKNTVYLQMNSLKPEDTAVYYCNLWPPRASPSGRIYWGQGTQVTVSS

SEQ ID NO: 21 - protein, 120 aa, Artificial Sequence
  Synthetic
QVQLQESGGGLVQPGGSLRLSCAASESTFSINAVAWYRQAPGKRRELVAGISGGGVTNYPDSVKGRFTISRDNAKNIVYLQMSSLKPEDTAVYYCNLWPPRASPGGRVYWGQGTQVTVSS

SEQ ID NO: 22 - protein, 120 aa, Artificial Sequence
  Synthetic
QVQLQESGGGLVQVGGSLRLSCADSGSTFSINSMGWYRQAPGKHRDWVAGITTDGITKYPDSLKGRFTISRDNAKNTVYLQMNSLKPEDTAVYYCNLWPPRASPSGRLYWGQGTQVTVSS

SEQ ID NO: 23 - protein, 120 aa, Artificial Sequence
  Synthetic
QVQLQESGGGLVQAGGSLRLSCAASGSTFSINAVAWYRQAPGKRRELVAGISGGGVTNYPDSVRGRFTISRDNAKNTVYLQMSSLKPEDTAVYYCNLWPPRASPDGRVYWGQGTQVTVSS

SEQ ID NO: 24 - protein, 120 aa, Artificial Sequence
  Synthetic
QVQLQESGGGLVQPGGSLTLACKGSGVELSRSAMAWYQQAPGKRRDWVAGITSSGVTQYPDSVKGRFTISRDNAKNTVYLQMNSLKPEDAAVYYCNLWPPRASPSGRIYWGQGTQVTVSS

SEQ ID NO: 25 - protein, 120 aa, Artificial Sequence
  Synthetic
QVQLQESGGGLVQPGGSLRLSCAASGSTFSVNAVAWYRQAPGKRRELVAGISGGGVTNYPDSVKGRFTISRDNAKNTVYLQMSSLIPEDTAVYYCNLWPPRASPGGRVYWGQGTQVTVSS

SEQ ID NO: 26 - protein, 121 aa, Artificial Sequence
  Synthetic
QVQLQESGGGLVQVGGSLRLSCAASGSTFSINNAMGWYRQAPGKRREWVAGISSGGVTHYPDSVKGRFTISRDNAKNIVYLQMDSLKPEDTAVYYCNLWPPRASPSGSIYWGQGTQVTVSS

SEQ ID NO: 27 - protein, 120 aa, Artificial Sequence
  Synthetic
QVQLQESGGGLVQAGGSLRLSCTASGSISSINAMAWYRQAPGKRRELVAGIDGGGVTNYPDSVKGRFTISRDNAKNTVYLQMSSLKPEDTAVYYCNLWPPRASPGGRVYWGQGTQVTVSS

SEQ ID NO: 28 - protein, 120 aa, Artificial Sequence
  Synthetic
QVQLQESGGGLVQPGGSLRLSCAASESTFSINAVAWYRQAPGKRRELVAGISGGGVTNHPDSVKGRFTISRDNAKNIVYLQMSSLKPEDTAVYYCNLWPPRASPGGRVYWGQGTQVTVSS

SEQ ID NO: 29 - protein, 120 aa, Artificial Sequence
  Synthetic
QVQLQESGGGLVQPGGSLRLSCADSGSTFTINAMGWYRQAPGKRRDWVAGITSSGVTQYPDSVKGRFTISRDNAKNTVYLQMNSLKPEDTAVYYCNLWPPRASPSGRIYWGQGTQVTVSS

SEQ ID NO: 30 - protein, 120 aa, Artificial Sequence
  Synthetic
QVQLQESGGGLVQVGGSLRLSCAASGSTFSINAMGWYRQAPGKRREWVAGISSSGPPHYPDSVKGRFTISRDNAKNTVYLQMNSLKPEDTAVYYCNLWPPMASPSGAIYWGQGTQVTVSS

SEQ ID NO: 31 - protein, 120 aa, Artificial Sequence
  Synthetic
QVQLQESGGGLVQPGGSLRLSCAVSGSIFSLNAMAWYRQAPGKRRELVAGISGGSVTNYPDSVKGRFTISRDSTKNTVYLQMSSLKPEDTAVYYCNLWPPRASPGGRVYWGQGTQVTVSS

SEQ ID NO: 32 - protein, 120 aa, Artificial Sequence
  Synthetic
QVQLQESGGGLVQPGGSLRLSCAASGSTFSINAMAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 33 - protein, 119 aa, Artificial Sequence
  Synthetic
  misc_feature (39)..(39): Xaa can be any naturally occurring amino acid
QVQLQESGGGLVQPGGSLRLICAASGSTFSGNAMAWYRXAPGKRRELVAGISGGITTYPDSVKGRFTISRDNAKNTVYLQMSSLKPEDTAVYYCNLWPPRASPGGLVYWGQGTQVTVSS

SEQ ID NO: 34 - protein, 121 aa, Artificial Sequence
  Synthetic
QVQLQESGGGLVQAGGSLRLSCADSSGSTFSINAMAWYRQAPGKRRDWVAGITSDSVTKYPDSVKGRFTISRDNAKNTVYLQMNSLKPEDTAVYYCNLWPPRASPSGRIDWGQGTQVTVSS

SEQ ID NO: 35 - protein, 121 aa, Artificial Sequence
  Synthetic
QVQLQESGGGLVQVGGSLRLSCAASGSTFSINNAMGWYRQAPGKRREWVAGISSGGVTHYPDSVKGRFTISRDNAKNIVYLQMNSLKPEDTAVYYCNLWPPRASPSGSIYWGQGTQVTVSS

SEQ ID NO: 36 - protein, 120 aa, Artificial Sequence
  Synthetic
QVQLQESGGGLVQVGGSLRLSCAASGSTFILNAMGWYRQAPGNRRELVAGISSGGDTNYPDSVKGRFTISRDNANNIVYLQMNSLKLEDTAVYYCNLWPPRASPSGRPYWGQGTQVTVSS

SEQ ID NO: 37 - protein, 120 aa, Artificial Sequence
  Synthetic
QVQLQESGGGLVQPGGSLRLSCAASGSIFSTNAMAWYRQAPGKRRELVAGISGGGVTNYPDSVKGRFTISRDNAKNTVYLQMSSLKPEDTAVYYCNLWPPRAPPDGRVYWGQGTQVTVSS

SEQ ID NO: 38 - protein, 120 aa, Artificial Sequence
  Synthetic
QVQLQESGGGMVQSGRSLRLSCLASVNIVNLNSVGWYRQAPGQQRELVASITSAGSTNYAESVKGRFTISRDNSKNTVYLQMNSLKPSDTAVYYCNLWPPRVSPSGRGYWGQGTQVTVSS

SEQ ID NO: 39 - protein, 120 aa, Artificial Sequence
  Synthetic
QVQLQESGGGLVQPGGSLRLSCAASGSISSINAMAWYRQAPGRRRELVAGIDGGGVTNYPDSVKGRFTISRDHAKNTVYLQMSSLKPEDTAVYYCNLWPPRASPGGRVYWGQGTQVTVSS

SEQ ID NO: 40 - protein, 121 aa, Artificial Sequence
  Synthetic
QVQLQESGGGLVQVGGSLRLSCAASGSTFSINNAMGWYRQAPGKRREWVAGISSGGVTHYPDSVKGRFAISRDNAKNIVYLQMDSLKPEDTAVYYCNLWPPRASPSGSIYWGQGTQVTVSS

SEQ ID NO: 41 - protein, 120 aa, Artificial Sequence
  Synthetic
QVQLQESGGGLVQVGGSLRLSCADSGSTFSINSMGWYRQAPGKRRDWVAGITTDGITKYPDSLKGRFTISRDNAKNTVYLQMNSLKPEDTAVYYCNLWPPRASPSGRLYWGQGTQVTVSS

SEQ ID NO: 42 - protein, 120 aa, Artificial Sequence
  Synthetic
QVQLQESGGGLVQAGGSLRLSCAASGSISSLNAMGWYRQAPGKQREWVAGITSGGSTNYADSVKGRFTILRDNAKNTVYLQMSSLKFEDTAVYYCNLWPPRASPSGAVYWGQGTQVTVSS

SEQ ID NO: 43 - protein, 6 aa, Artificial Sequence
  Synthetic
HHHHHH

SEQ ID NO: 44 - protein, 10 aa, Artificial Sequence
  Synthetic
YPYDVPDYGS

SEQ ID NO: 45 - protein, 19 aa, Artificial Sequence
  Synthetic
AAAYPYDVPDYGSHHHHHH

SEQ ID NO: 46 - protein, 120 aa, Artificial Sequence
  Synthetic
QVQLQESGGGLVQVGGSLRLSCADSGSTFSINAMGWYRQAPGKRRDWVAGITSDGVTKYPDSVKGRFTISRDNAKNTVYLQMNSLKPEDTAVYYCNLWPPRVSPSGRIYWGQGTQVTVSS

SEQ ID NO: 47 - protein, 121 aa, Artificial Sequence
  Synthetic
QVQLQESGGGLVQVGGSLRLSCAASGSTFSINNAMGWYRQAPGKRREWVAGISSGGVTHYPDSVKGRFTISRDNAKNIVYLQMDSLKPEDTAAYYCNLWPPRASPSGSIYWGQGTQVTVSS

SEQ ID NO: 48 - protein, 120 aa, Artificial Sequence
  Synthetic
QVQLQESGGGLVQPGGSLRLSCAASESTFSINAVAWYRQAPGKRRELVAGISGGGVTNYPDSVKGRFTISRDNAKNIVYLQMSSLKPEDTAVYYCNLWPPRAPPGGRVYWGQGTQVTVSS

SEQ ID NO: 49 - protein, 120 aa, Artificial Sequence
  Synthetic
QVQLQESGGGLVQVGGSLRLSCADSGSTFSINAMGWYRQAPGKRRDWVAGITSSGVTKYPDSVKGRFTISRDNAKNTVYLQMNSLKPEDTAVYYCNLWPPRASPSGRIYWGQGTQVTVSS

SEQ ID NO: 50 - protein, 120 aa, Artificial Sequence
  Synthetic
QVQLQESGGGLVQAGGSLKLSCAGSGSTFSINAMAWYRQAPGERRELVAGISGDNITNYPDSVKGRFTISRDNAKNTVYLQMSSLKPEDTAVYYCNLWPPRASPGGRVYWGQGTQVTVSS

SEQ ID NO: 51 - protein, 120 aa, Artificial Sequence
  Synthetic
QVQLQESGGGLVQPGGSLRLSCAASGSTFSINAMAWYRQAPGQRRELVAGISGGGVTNYPDSVKGRFTISRDNAKNTVYLQMSSLKPEDTAVYYCNLWPPRASPGGRVYWGQGTQVTVSS

SEQ ID NO: 52 - protein, 120 aa, Artificial Sequence
  Synthetic
QVQLQESGGGLVQPGGSLRLSCAASGSTFSGNAMAWYRQAPGKRRELVAGISGGGVTNYPDSVKGRFTISRDNAKNTVYLQMSSLKPEDTAVYYCNLWPPRVSPGGGVYWGQGTQVTVSS

SEQ ID NO: 53 - protein, 120 aa, Artificial Sequence
  Synthetic
QVQLQESGGGLVQAGESLRLSCAASGRDFRDNSMGWYRQAPGKRREWVAGISSGGVTHYPDSVKGRFTISRDNAKNIVYLQMDSLKPEDTAVYYCNLWPPRASPSGSIYWGQGTQVTVSS

SEQ ID NO: 54 - protein, 120 aa, Artificial Sequence
  Synthetic
QVQLQESGGGLVQPEGSLRLSCAASGSISSINAMAWYRQAPGKRRELVAGIDGGGVTNYPDSVKGRFTISRDNAKNTVYLQMSSLKPEDTAVYYCNLWPPRASPGGRVYWGQGTQVTVSS

SEQ ID NO: 55 - protein, 120 aa, Artificial Sequence
  Synthetic
QVQLQESGGGLVQPGESLRLSCAVSGSTSSMNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 56 - protein, 120 aa, Artificial Sequence
  Synthetic
QVQLQESGGGLVQAGGSLRLSCAASGSTFSVNAVAWYRQAPGKRRELVAGISGGGVTNYPDSVKGRFTISRDNAKNTVYLQMSSLKPEDTAVYYCNLWPPRASPDGRVYWGQGTQVTVSS

SEQ ID NO: 57 - protein, 120 aa, Artificial Sequence
  Synthetic
QVQLQESGGGLVQPGGSLRLSCAASGSTFSINAMAWYRQAPGKRRELVAGISGGDVTHYPDSVKGRFTISRDNAKNTVYLQMSSLKPEDTAVYYCNLWPPRASPGGRVYWGQGTQVTVSS

SEQ ID NO: 58 - protein, 120 aa, Artificial Sequence
  Synthetic
QVQLQESGGGLVQPGGSLRLSCAASGSTFSINAVAWYRQAPGKRRELVAGISGGGVTNYPDSVKGRFTISRDNAKNTVYLQMSSLIPEDTAVYYCNLWPPRASPGGRVYWGQGTQVTVSS

SEQ ID NO: 59 - protein, 120 aa, Artificial Sequence
  Synthetic
QVQLQESGGGLVQPGGSLRLSCAGSGSTFSINAMAWYRQAPGERRELVAGISGDNITNYPNSVKGRFTISRDNAKNTVYLQMSSLKPEDTAVYYCNLWPPRASPGGRVYWGQGTQVTVSS

SEQ ID NO: 60 - protein, 120 aa, Artificial Sequence
  Synthetic
QVQLQESGGGLVQPGGSLRLSCAASGSTFSVNAVAWYRQAPGKRRELVAGISGGGVTNYPDSVKGRFTISRDNAKNTVYLQMSSLKPEDTAVYYCNLWPPRASPDGRVYWGQGTQVTVSS

SEQ ID NO: 61 - protein, 120 aa, Artificial Sequence
  Synthetic
QVQLQESGGGLVQPGGSLRLSCAASGSTFSSNAMAWYRQAPGKRRELVAGISGGGVTNYPDSVKGRFTISRDNAKNTVYLQMSSLKPEDTAVYYCNLWPPRASPDGGVYWGQGTQVTVSS

SEQ ID NO: 62 - protein, 120 aa, Artificial Sequence
  Synthetic
QVQLQESGGGLVQPGGSLTLSCTTSEFTLAYFGVGWFRQAPGKRRDWVAGITTDGITKYPDSLKGRFTISRDNAKNTVYLQMNSLKPEDTAVYYCNLWPPRASPSGRLYWGQGTQVTVSS

SEQ ID NO: 63 - protein, 120 aa, Artificial Sequence
  Synthetic
QVQLQESGGGLVQAGGSLRLSCAASGSTFSGNAMAWYRRAPGKRRELVAGISGGGVTNYPDSVKGRFTISRDNAKNTVYLQMSSLKPEDTAVYYCNLWPPRVSPGGRVYWGQGTQVTVSS

SEQ ID NO: 64 - protein, 119 aa, Artificial Sequence
  Synthetic
QVQLQESGGGLVQPGGSLRLSCADSGSTFTINAMAWYRQAPGKRRELVAGISGGVTNYPDSVKGRFTISRDNAKNTVYLQMSSLKPEDTAVYYCNLWPPRASPDGRVYWSQGTQVTVSS

SEQ ID NO: 65 - protein, 120 aa, Artificial Sequence
  Synthetic
QVQLQESGGGLVQPEGSLRLSCAASGSISSINAMAWYRQAPGKRRELVAGIDGGGVTNYPDSVKGRFTISRDNAKNTVYLQMSSLKPEDTAVYYCNLWPPRASPGGRVYWGKGTQVTVSS

SEQ ID NO: 66 - protein, 119 aa, Artificial Sequence
  Synthetic
QVQLQESGGGLVQVGGSLRLSCAASGSTFSINAMGWYRQAPGKRREWVAGITSGVTHYPDSVKGRFTISRDNAKNTVYLQMNSLKPEDTAVYYCNLWPPRASPSGSIYWGQGTQVTVSS

SEQ ID NO: 67 - protein, 121 aa, Artificial Sequence
  Synthetic
QVQLQESGGGLVQVGGSLRLSCAASGSTFSINNAMGWYRQAPGKRREWVAGISSGGVTHYPDSVKGRFTISRDNAKNIVYLQMNSPKPEDTAVYYCNLWPPRASPSGSIYWGQGTQVTVSS

SEQ ID NO: 68 - protein, 120 aa, Artificial Sequence
  Synthetic
QVQLQESGGGLVQPGESLRLSCAVSGSTSSMNAMAWYRQAPGKRRELVAGISGGGATNYPDSMKGRFTISRDNAKNTVYLQMSSLKPEDTAVYYCNLWPPRASPGGGVYWGQGTQVTVSS

SEQ ID NO: 69 - protein, 120 aa, Artificial Sequence; identical to SEQ ID NO: 54
  Synthetic

SEQ ID NO: 70 - protein, 115 aa, Artificial Sequence
  Synthetic
QVQLQESGGGLVQAGGSLRLSCADSGSTFGLSAMGWYRQTPGKQRELVASITSDGRTNYADSVKGRFTISRVNPKRTVYLQMNSLKPDDTAVYVCNARFGIRDFWGQGTQVTVSS

SEQ ID NO: 71 - protein, 115 aa, Artificial Sequence
  Synthetic
QVQLQESGGGLVQPGGSLRLSCADSGSTFGLSAMGWYRQTPGKQRELVASITSDGRTNYADSVKGRFTISRVNPKRTVYLQMNSLKPDDTAVYVCNARFGIRDFWGQGTQVTVSS

SEQ ID NO: 72 - protein, 115 aa, Artificial Sequence
  Synthetic
QVQLQESGGGLVQAGGSLRLSCADSGSTFGLGAMGWYRQSPGKQRELVASITSGGRTNYADSVKGRFTISRVNAKRTVYLQMNSLKPEDTAVYVCNARFGIRDFWGQGTQVTVSS

SEQ ID NO: 73 - protein, 115 aa, Artificial Sequence
  Synthetic
QVQLQESGGGLVQAGGSLRLSCADSGSTFGLGAMGWYRQSPGKQRELVASITSGGRTNYSDSVKGRFTISRVNPKRIVYLQMNSLKPEDTAVYVCNARFGIRDFWGQGTQVTVSS

SEQ ID NO: 74 - protein, 115 aa, Artificial Sequence
  Synthetic
QVQLQESGGGLVQAGGSLRLSCADSGSTFGLSAMGWYRLTPGKQRELVASITSDGRTNYADSVKGRFTISRVNPKRTVYLQMNSLKPDDTAVYVCNARFGIRDFWGQGTQVTVSS

SEQ ID NO: 75 - protein, 115 aa, Artificial Sequence
  Synthetic
QVQLQESGGGLVQPGGSLRLSCADSGSTFGLGAMGWYRQSPGKQRELVASITSGGRTNYADSVKGRFTISRVGAKRTVYLQMNSLKPEDTAVYVCNARFGIRDFWGQGTQVTVSS

SEQ ID NO: 76 - protein, 115 aa, Artificial Sequence
  Synthetic
QVQLQESGGGLVQAGGSLRLSCADSGSTFGLTAIGWYRQSPGKQRELVASITSGGRTNYADSVKGRFTISRVNPKRTVYLQMNSLKPEDTAVYVCNARFGIRDFWGQGTQVTVSS

SEQ ID NO: 77 - protein, 115 aa, Artificial Sequence
  Synthetic
QVQLQESGGGLVQAGGSLRLSCADSGSTFGLGAMGWYRQSPGKQRELVASITSGGRTNYADSVKGRFTISRVGAKRTVYLQMNSLKPEDTAVYVCNARFGIRDFWGQGTQVTVSS

SEQ ID NO: 78 - protein, 115 aa, Artificial Sequence
  Synthetic
QVQLQESGGGLVQAGGSLRLSCADSGSTFGLGAMGWYRQSPGKQRELVASITSGGRTNYADSVKGRFTISRENPKRTVYLQMNSLKPEDTAVYVCNARFGIRDFWGQGTQVTVSS

SEQ ID NO: 79 - protein, 115 aa, Artificial Sequence
  Synthetic
QVQLQESGGGLVQAGGSLRLSCADSGSTFGLGAMGWYRQSPGKQRELVASITSGGRTNYADSVKGRFTISRVGAKRTVYLQMNSLRPEDTAVYVCNARFGIRDFWGQGTQVTVSS

SEQ ID NO: 80 - protein, 115 aa, Artificial Sequence
  Synthetic
QVQLQESGGGLVQAGGSLRLSCADSGSTFGLGAMGWYRQSPGKQRELVASITSGGRTNYADSVKGRFTISRVSAKRTVYLQMNSLKPEDTAVYVCNARFGIRDFWGQGTQVTVSS

SEQ ID NO: 81 - protein, 115 aa, Artificial Sequence
  Synthetic
QVQLQESGGGLVRPGGSLRLSCADSGSTFGLSAMGWYRQSPGKQRELVASIISDGRTNYADSVKGRFTISRVNAKRTVYLQMNSLKPEDTAVYVCNARFGIRDFWGQGTQVTVSS

SEQ ID NO: 82 - protein, 115 aa, Artificial Sequence
  Synthetic
QVQLQESGGGLVQAGGSLRLSCADSGSTFGLSAMGWYRQSPGKQRELVASIISDGRTNYADSVKGRFTISRVNAKRTVYLQMNSLKPEDTAVYVCNARFGIRDFWGQGTQVTVSS

SEQ ID NO: 83 - protein, 115 aa, Artificial Sequence
  Synthetic
QVQLQESGGGLVQAGGSLRLSCADSGSTFGLGAMGWYRQSPGKQRELVASITSGGRTNYSDSVKGRFTISRVTPKRIVYLQMNSLKPEDTAVYVCNARFGIRDFWGQGTQVTVSS

SEQ ID NO: 84 - protein, 116 aa, Artificial Sequence
  Synthetic
QVQLQESGGGLVQAGGSLRLSCAASGSIFGINAVGWYRQAPGKQRELVATFTRGGDINYADSVKGRFTIFRDNAANTVYLQMNSLKAEDTAVYYCNTPPRIGRGYWGQGTQVTVSS

SEQ ID NO: 85 - protein, 116 aa, Artificial Sequence
  Synthetic
QVQLQESGGGLVQVGGSLRLSCAASGSIFGINAVGWYRQAPGKQRELVATFTRGGDINYADSVKGRFTIFRDNAANTVYLQMNSLKAEDTAVYYCNTPPRIGRGYWGQGTQVTVSS

SEQ ID NO: 86 - protein, 116 aa, Artificial Sequence
  Synthetic
QVQLQESGGGLVQPGGSLRLSCAASGSIFGINAVGWYRQAPGKQRELVATFTRGGDINYADSVKGRFTIFRDNAANTVYLQMNSLKAEDTAVYYCNTPPRIGRGYWGQGTQVTVSS

SEQ ID NO: 87 - protein, 10 aa, Artificial Sequence
  Synthetic
ATISSMNSMA

SEQ ID NO: 88 - protein, 10 aa, Artificial Sequence
  Synthetic
EFTLAYFGVG

SEQ ID NO: 89 - protein, 10 aa, Artificial Sequence
  Synthetic
ESTFSINAVA

SEQ ID NO: 90 - protein, 10 aa, Artificial Sequence
  Synthetic
GFIFRSTSMG

SEQ ID NO: 91 - protein, 10 aa, Artificial Sequence
  Synthetic
GGIFTIGPLG

SEQ ID NO: 92 - protein, 10 aa, Artificial Sequence
  Synthetic
GRDFRDNSMG

SEQ ID NO: 93 - protein, 10 aa, Artificial Sequence
  Synthetic
GSIFGINAVG

SEQ ID NO: 94 - protein, 10 aa, Artificial Sequence
  Synthetic
GSIFSLNAMA

SEQ ID NO: 95 - protein, 7 aa, Artificial Sequence
  Synthetic
GSIFSMG

SEQ ID NO: 96 - protein, 10 aa, Artificial Sequence
  Synthetic
GSIFSTNAMA

SEQ ID NO: 97 - protein, 10 aa, Artificial Sequence
  Synthetic
GSISSINAMA

SEQ ID NO: 98 - protein, 10 aa, Artificial Sequence
  Synthetic
GSISSLNAMG

SEQ ID NO: 99 - protein, 10 aa, Artificial Sequence
  Synthetic
GSISSRNAMG

SEQ ID NO: 100 - protein, 10 aa, Artificial Sequence
  Synthetic
GSSFIINAMG

SEQ ID NO: 101 - protein, 10 aa, Artificial Sequence
  Synthetic
GSTARLDAMG

SEQ ID NO: 102 - protein, 10 aa, Artificial Sequence
  Synthetic
GSTFGLGAMG

SEQ ID NO: 103 - protein, 10 aa, Artificial Sequence
  Synthetic
GSTFGLSAMG

SEQ ID NO: 104 - protein, 10 aa, Artificial Sequence
  Synthetic
GSTFGLTAIG

SEQ ID NO: 105 - protein, 10 aa, Artificial Sequence
  Synthetic
GSTFILNAMA

SEQ ID NO: 106 - protein, 10 aa, Artificial Sequence
  Synthetic
GSTFILNAMG

SEQ ID NO: 107 - protein, 10 aa, Artificial Sequence
  Synthetic
GSTFSGNAMA

SEQ ID NO: 108 - protein, 10 aa, Artificial Sequence
  Synthetic
GSTFSINAMA

SEQ ID NO: 109 - protein, 10 aa, Artificial Sequence
  Synthetic
GSTFSINAMG

SEQ ID NO: 110 - protein, 10 aa, Artificial Sequence
  Synthetic
GSTFSINAMM

SEQ ID NO: 111 - protein, 10 aa, Artificial Sequence
  Synthetic
GSTFSINAVA

SEQ ID NO: 112 - protein, 11 aa, Artificial Sequence
  Synthetic
GSTFSINNAMG

SEQ ID NO: 113 - protein, 10 aa, Artificial Sequence
  Synthetic
GSTFSINSMG

SEQ ID NO: 114 - protein, 10 aa, Artificial Sequence
  Synthetic
GSTFSSNAMA

SEQ ID NO: 115 - protein, 10 aa, Artificial Sequence
  Synthetic
GSTFSVNAVA

SEQ ID NO: 116 - protein, 16 aa, Artificial Sequence
  Synthetic
AISSGGSTNYAASVKG

SEQ ID NO: 117 - protein, 16 aa, Artificial Sequence
  Synthetic
AVTSGGVTNYADSVKG

SEQ ID NO: 118 - protein, 16 aa, Artificial Sequence
  Synthetic
GIATDGRTNYAHSVKG

SEQ ID NO: 119 - protein, 16 aa, Artificial Sequence
  Synthetic
GIDGGGVTNYPDSVKG

SEQ ID NO: 120 - protein, 16 aa, Artificial Sequence
  Synthetic
GIDSADITDYARFVKG

SEQ ID NO: 121 - protein, 16 aa, Artificial Sequence
  Synthetic
GIIGSHSTNYADSVKG

SEQ ID NO: 122 - protein, 16 aa, Artificial Sequence
  Synthetic
GISGDNITNYPDSVKG

SEQ ID NO: 123 - protein, 16 aa, Artificial Sequence
  Synthetic
GISGDNITNYPNSVKG

SEQ ID NO: 124 - protein, 16 aa, Artificial Sequence
  Synthetic
GISGGDVTHYPDSVKG

SEQ ID NO: 125 - protein, 16 aa, Artificial Sequence
  Synthetic
GISGGGATNYPDSMKG

SEQ ID NO: 126 - protein, 16 aa, Artificial Sequence
  Synthetic
GISGGGATNYPDSVKG

SEQ ID NO: 127 - protein, 16 aa, Artificial Sequence
  Synthetic
GISGGGVTNHPDSVKG

SEQ ID NO: 128 - protein, 16 aa, Artificial Sequence
  Synthetic
GISGGGVTNYPDSVKG

SEQ ID NO: 129 - protein, 16 aa, Artificial Sequence
  Synthetic
GISGGGVTNYPDSVRG

SEQ ID NO: 130 - protein, 16 aa, Artificial Sequence
  Synthetic
GISGGGVTSYPDSVKG

SEQ ID NO: 131 - protein, 15 aa, Artificial Sequence
  Synthetic
GISGGITTYPDSVKG

SEQ ID NO: 132 - protein, 16 aa, Artificial Sequence
  Synthetic
GISGGSVTNYPDSVKG

SEQ ID NO: 133 - protein, 15 aa, Artificial Sequence
  Synthetic
GISGGVTNYPDSVKG

SEQ ID NO: 134 - protein, 16 aa, Artificial Sequence
  Synthetic
GISSDDITYYPDSVKG

SEQ ID NO: 135 - protein, 16 aa, Artificial Sequence
  Synthetic
GISSDGATHYPDSVKG

SEQ ID NO: 136 - protein, 16 aa, Artificial Sequence
  Synthetic
GISSGGDTNYPDSVKG

SEQ ID NO: 137 - protein, 16 aa, Artificial Sequence
  Synthetic
GISSGGVTHYPDSVKG

SEQ ID NO: 138 - protein, 16 aa, Artificial Sequence
  Synthetic
GISSSGPPHYPDSVKG

SEQ ID NO: 139 - protein, 16 aa, Artificial Sequence
  Synthetic
GITSDGITNYADSVKG

SEQ ID NO: 140 - protein, 16 aa, Artificial Sequence
  Synthetic
GITSDGLGNYVDFVKG

SEQ ID NO: 141 - protein, 16 aa, Artificial Sequence
  Synthetic
GITSDGLGNYVGFAKG

SEQ ID NO: 142 - protein, 16 aa, Artificial Sequence
  Synthetic
GITSDGVTKYPDSVKG

SEQ ID NO: 143 - protein, 16 aa, Artificial Sequence
  Synthetic
GITSDGVTNYPDSVKG

SEQ ID NO: 144 - protein, 16 aa, Artificial Sequence
  Synthetic
GITSDSVTKYPDSVKG

SEQ ID NO: 145 - protein, 17 aa, Artificial Sequence
  Synthetic
AAVVTAKGMGAIQSRGY

SEQ ID NO: 146 - protein, 18 aa, Artificial Sequence
  Synthetic
ADSSRGKIYFSNYRSWNY

SEQ ID NO: 147 - protein, 8 aa, Artificial Sequence
  Synthetic
ARFGIRDF

SEQ ID NO: 148 - protein, 9 aa, Artificial Sequence
  Synthetic
FWPPLYGRP

SEQ ID NO: 149 - protein, 10 aa, Artificial Sequence
  Synthetic
FWPPPSDRPI

SEQ ID NO: 150 - protein, 10 aa, Artificial Sequence
  Synthetic
FWPPPSGRPI

SEQ ID NO: 151 - protein, 9 aa, Artificial Sequence
  Synthetic
KWPPSVPPN

SEQ ID NO: 152 - protein, 13 aa, Artificial Sequence
  Synthetic
LWPPMASPSGAIY

SEQ ID NO: 153 - protein, 13 aa, Artificial Sequence
  Synthetic
LWPPRAPPDGRVY

SEQ ID NO: 154 - protein, 13 aa, Artificial Sequence
  Synthetic
LWPPRAPPGGRVY

SEQ ID NO: 155 - protein, 13 aa, Artificial Sequence
  Synthetic
LWPPRASPDGGVY

SEQ ID NO: 156 - protein, 13 aa, Artificial Sequence
  Synthetic
LWPPRASPDGRVY

SEQ ID NO: 157 - protein, 13 aa, Artificial Sequence
  Synthetic
LWPPRASPGGGVY

SEQ ID NO: 158 - protein, 13 aa, Artificial Sequence
  Synthetic
LWPPRASPGGLVY

SEQ ID NO: 159 - protein, 13 aa, Artificial Sequence
  Synthetic
LWPPRASPGGRVY

SEQ ID NO: 160 - protein, 13 aa, Artificial Sequence
  Synthetic
LWPPRASPSGAVY

SEQ ID NO: 161 - protein, 13 aa, Artificial Sequence
  Synthetic
LWPPRASPSGRGY

SEQ ID NO: 162 - protein, 13 aa, Artificial Sequence
  Synthetic
LWPPRASPSGRID

SEQ ID NO: 163 - protein, 13 aa, Artificial Sequence
  Synthetic
LWPPRASPSGRIY

SEQ ID NO: 164 - protein, 13 aa, Artificial Sequence
  Synthetic
LWPPRASPSGRLY

SEQ ID NO: 165 - protein, 13 aa, Artificial Sequence
  Synthetic
LWPPRASPSGRPY

SEQ ID NO: 166 - protein, 13 aa, Artificial Sequence
  Synthetic
LWPPRASPSGRVY

SEQ ID NO: 167 - protein, 13 aa, Artificial Sequence
  Synthetic
LWPPRASPSGSIY

SEQ ID NO: 168 - protein, 13 aa, Artificial Sequence
  Synthetic
LWPPRASPSGTIY

SEQ ID NO: 169 - protein, 13 aa, Artificial Sequence
  Synthetic
LWPPRVSPGGGVY

SEQ ID NO: 170 - protein, 13 aa, Artificial Sequence
  Synthetic
LWPPRVSPGGRVY

SEQ ID NO: 171 - protein, 13 aa, Artificial Sequence
  Synthetic
LWPPRVSPSGRGY

SEQ ID NO: 172 - protein, 13 aa, Artificial Sequence
  Synthetic
LWPPRVSPSGRIY

SEQ ID NO: 173 - protein, 9 aa, Artificial Sequence
  Synthetic
LYPPASSGR

SEQ ID NO: 174 - protein, 9 aa, Artificial Sequence
  Synthetic
MYRPGTYDY

SEQ ID NO: 175 - protein, 9 aa, Artificial Sequence
  Synthetic
QWPPRALDA

SEQ ID NO: 176 - protein, 165 aa, Artificial Sequence
  Synthetic polymer.
CDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 177 - protein, 165 aa, Artificial Sequence [sequence omitted]

SEQ ID NO: 178 - protein, 166 aa, Artificial Sequence
  Synthetic polymer.
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 179 - protein, 166 aa, Artificial Sequence
  Synthetic polymer.
CDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 180 - protein, 165 aa, Artificial Sequence
  Synthetic polymer.
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 181 - protein, 165 aa, Artificial Sequence
  Synthetic polymer.
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 182 - protein, 157 aa, Artificial Sequence [sequence omitted]

SEQ ID NO: 183 - protein, 170 aa, Artificial Sequence
  Synthetic polymer.
LPGVGLTPSAAQTARQHPKMHLAHSNLKPAAHLIGDPSKQNSLLWRANTDRAFLQDGFSLSNNSLLVPTSGIYFVYSQWFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 184 - protein, 281 aa, Artificial Sequence [sequence omitted]

SEQ ID NO: 185 - protein, 153 aa, Artificial Sequence
  Synthetic polymer.
APVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIELNNKLEFESAQFPNWYISTSQAENMPVFLGGTKGGQDITDFTMQFVSS

SEQ ID NO: 186 - protein, 133 aa, Artificial Sequence [sequence omitted]

SEQ ID NO: 187 - protein, 129 aa, Artificial Sequence [sequence omitted]

SEQ ID NO: 188 - protein, 185 aa, Artificial Sequence
  Synthetic polymer.
APVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLTTKLQAQNQWLQDMTTHLILRSFKEFLQSSLRALRQM

SEQ ID NO: 189 - protein, 114 aa, Artificial Sequence
  Synthetic polymer.
SPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFN

SEQ ID NO: 190 - protein, 194 aa, Artificial Sequence
  Synthetic polymer.
MAAEPVEDNCINFVAMKFIDNTLYFIAEDDENLESDYFGKLESKLSVIRNLNDQVLFIDQGNRPLFEDMTDSDCRDNAPRTIFLISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNEDL

SEQ ID NO: 191 - protein, 270 aa, Artificial Sequence
  Synthetic polymer.
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 192 - protein, 10 aa, Artificial Sequence
  Synthetic polymer.
GFTFDDYAMS

SEQ ID NO: 193 - protein, 10 aa, Artificial Sequence
  Synthetic polymer.
GFTFDDYAIG

SEQ ID NO: 194 - protein, 17 aa, Artificial Sequence
  Synthetic polymer.
TINWNGGSAEYAEPVKG

SEQ ID NO: 195 - protein, 17 aa, Artificial Sequence
  Synthetic polymer.
CIRVSDGSTYYADPVKG

SEQ ID NO: 196 - protein, 11 aa, Artificial Sequence
  Synthetic polymer.
KDADLVWYNLS

SEQ ID NO: 197 - protein, 11 aa, Artificial Sequence
  Synthetic polymer.
KDADLVWYNLR

SEQ ID NO: 198 - protein, 23 aa, Artificial Sequence
  Synthetic polymer.
AGSLYTCVQSIWVPARPYYDMDY

SEQ ID NO: 199 - protein, 132 aa, Artificial Sequence
  Synthetic polymer.
QVQLQESGGGSVQPGGSLRLSCAASGFTFDDYAMSWVRQVPGKGLEWVSTINWNGGSAEYAEPVKGRFTISRDNAKNTVYLQMNSLKLEDTAVYYCAKDADLVWYNLSTGQGTQVTVSSAAAYPYDVPDYGS

SEQ ID NO: 200 - protein, 132 aa, Artificial Sequence
  Synthetic polymer.
QVQLQESGGGLVQPGGSLRLSCAASGFTFDDYAMSWVRQVPGKGLEWVSTINWNGGSAEYAEPVKGRFTISRDNAKNTVYLQMNSLKLEDTAVYYCAKDADLVWYNLRTGQGTQVTVSSAAAYPYDVPDYGS

SEQ ID NO: 201 - protein, 145 aa, Artificial Sequence
  Synthetic polymer.
QVQLQESGGGLVQAGGSLRLSCAASGFTFDDYAIGWFRQAPGKEREGVSCIRVSDGSTYYADPVKGRFTISSDNAKNTVYLQMNSLKPEDAAVYYCAAGSLYTCVQSIVVVPARPYYDMDYWGKGTQVTVSSAAAYPYDVPDYGS

SEQ ID NO: 202 - protein, 10 aa, Artificial Sequence
  Synthetic polymer.
GRSFSSYTLA

SEQ ID NO: 203 - protein, 10 aa, Artificial Sequence
  Synthetic polymer.
GRTFSSYTMG

SEQ ID NO: 204 - protein, 10 aa, Artificial Sequence
  Synthetic polymer.
GRTFSSYIMG

SEQ ID NO: 205 - protein, 10 aa, Artificial Sequence
  Synthetic polymer.
GRTFSSYTMG

SEQ ID NO: 206 - protein, 14 aa, Artificial Sequence
  Synthetic polymer.
GRTSGRTFSSYTMG

SEQ ID NO: 207 - protein, 10 aa, Artificial Sequence
  Synthetic polymer.
GRTFSSYAMG

SEQ ID NO: 208 - protein, 10 aa, Artificial Sequence
  Synthetic polymer.
GLTFSNYIMG

SEQ ID NO: 209 - protein, 10 aa, Artificial Sequence
  Synthetic polymer.
GRTFSSYTMG

SEQ ID NO: 210 - protein, 10 aa, Artificial Sequence
  Synthetic polymer.
GRTFSSDTMG

SEQ ID NO: 211 - protein, 10 aa, Artificial Sequence
  Synthetic polymer.
GLTFSNYIMG

SEQ ID NO: 212 - protein, 10 aa, Artificial Sequence
  Synthetic polymer.
GFTLDYYGIG

SEQ ID NO: 213 - protein, 10 aa, Artificial Sequence
  Synthetic polymer.
GHTFSSYTMG

SEQ ID NO: 214 - protein, 10 aa, Artificial Sequence
  Synthetic polymer.
GRTFSSYVIG

SEQ ID NO: 215 - protein, 10 aa, Artificial Sequence
  Synthetic polymer.
GFAFDGYAIG

SEQ ID NO: 216 - protein, 10 aa, Artificial Sequence
  Synthetic polymer.
GFAFGFFDMT

SEQ ID NO: 217 - protein, 10 aa, Artificial Sequence
  Synthetic polymer.
GRTFSNYVIG

SEQ ID NO: 218 - protein, 10 aa, Artificial Sequence
  Synthetic polymer.
GSIFSINVMG

SEQ ID NO: 219 - protein, 10 aa, Artificial Sequence
  Synthetic polymer.
GRTFSNYNVG

SEQ ID NO: 220 - protein, 10 aa, Artificial Sequence
  Synthetic polymer.
GHTFSSYTMG

SEQ ID NO: 221 - protein, 10 aa, Artificial Sequence
  Synthetic polymer.
GRTFSTYPVG

SEQ ID NO: 222 - protein, 10 aa, Artificial Sequence
  Synthetic polymer.
GRTFSNYAMG

SEQ ID NO: 223 - protein, 10 aa, Artificial Sequence
  Synthetic polymer.
GRTFSDYRMG

SEQ ID NO: 224 - protein, 10 aa, Artificial Sequence
  Synthetic polymer.
GLTFSNYIMA

SEQ ID NO: 225 - protein, 10 aa, Artificial Sequence
  Synthetic polymer.
GRTFSNSVMG

SEQ ID NO: 226 - protein, 10 aa, Artificial Sequence
  Synthetic polymer.
GRTFSSYIIG

SEQ ID NO: 227 - protein, 10 aa, Artificial Sequence
  Synthetic polymer.
GRTFSSYVMG

SEQ ID NO: 228 - protein, 10 aa, Artificial Sequence
  Synthetic polymer.
GGTFSNYVMG

SEQ ID NO: 229 - protein, 10 aa, Artificial Sequence
  Synthetic polymer.
GRTFSNYGIG

SEQ ID NO: 230 - protein, 10 aa, Artificial Sequence
  Synthetic polymer.
GFTFDDYAIA

SEQ ID NO: 231 - protein, 10 aa, Artificial Sequence
  Synthetic polymer.
GRTFSSYTVA

SEQ ID NO: 232 - protein, 10 aa, Artificial Sequence
  Synthetic polymer.
GFPFDDYAIA

SEQ ID NO: 233 - protein, 10 aa, Artificial Sequence
  Synthetic polymer.
GRTFSSYVMG

SEQ ID NO: 234 - protein, 10 aa, Artificial Sequence
  Synthetic polymer.
GRTLSSNPMA

SEQ ID NO: 235 - protein, 10 aa, Artificial Sequence
  Synthetic polymer.
GFTFDNYAIG

SEQ ID NO: 236 - protein, 10 aa, Artificial Sequence
  Synthetic polymer.
GRAFSSYFMG

SEQ ID NO: 237 - protein, 10 aa, Artificial Sequence
  Synthetic polymer.
TPTFSSYNMG

SEQ ID NO: 238 - protein, 10 aa, Artificial Sequence
  Synthetic polymer.
GFTFDDYAIA

SEQ ID NO: 239 - protein, 10 aa, Artificial Sequence
  Synthetic polymer.
GGTFSGYIMG

SEQ ID NO: 240 - protein, 10 aa, Artificial Sequence
  Synthetic polymer.
GRSFSSYTIA

SEQ ID NO: 241 - protein, 10 aa, Artificial Sequence
  Synthetic polymer.
GFSSDDYTIG

SEQ ID NO: 242 - protein, 10 aa, Artificial Sequence
  Synthetic polymer.
GFTFDDYTIG

SEQ ID NO: 243 - protein, 10 aa, Artificial Sequence
  Synthetic polymer.
GFSSDDYTIG

SEQ ID NO: 244 - protein, 10 aa, Artificial Sequence
  Synthetic polymer.
GFTFDQYTIA

SEQ ID NO: 245 - protein, 10 aa, Artificial Sequence
  Synthetic polymer.
GRTFSSYAMA

SEQ ID NO: 246 - protein, 10 aa, Artificial Sequence
  Synthetic polymer.
GFAFDGYAIG

SEQ ID NO: 247 - protein, 10 aa, Artificial Sequence
  Synthetic polymer.
GFSSDDYTIA

SEQ ID NO: 248 - protein, 10 aa, Artificial Sequence
  Synthetic polymer.
GFSSDDYTIG

SEQ ID NO: 249 - protein, 10 aa, Artificial Sequence
  Synthetic polymer.
GFTFDDYTIG

SEQ ID NO: 250 - protein, 10 aa, Artificial Sequence
  Synthetic polymer.
GFSSDDYTIG

SEQ ID NO: 251 - protein, 10 aa, Artificial Sequence
  Synthetic polymer.
GFSSDDYTIG

SEQ ID NO: 252 - protein, 10 aa, Artificial Sequence
  Synthetic polymer.
GFSFDDYAIA

SEQ ID NO: 253 - protein, 10 aa, Artificial Sequence
  Synthetic polymer.
GFSSDDYTIG

SEQ ID NO: 254 - protein, 10 aa, Artificial Sequence
  Synthetic polymer.
GFTGNDLAIG

SEQ ID NO: 255 - protein, 10 aa, Artificial Sequence
  Synthetic polymer.
GFSSDDYTIA

SEQ ID NO: 256 - protein, 10 aa, Artificial Sequence
  Synthetic polymer.
EGTLSSYGIG

SEQ ID NO: 257 - protein, 10 aa, Artificial Sequence
  Synthetic polymer.
GFSSDDYTIA

SEQ ID NO: 258 - protein, 10 aa, Artificial Sequence
  Synthetic polymer.
GFTFDDYAIA

SEQ ID NO: 259 - protein, 10 aa, Artificial Sequence
  Synthetic polymer.
GLSSDDYTIG

SEQ ID NO: 260 - protein, 10 aa, Artificial Sequence
  Synthetic polymer.
GLSSDDYTIG

SEQ ID NO: 261 - protein, 10 aa, Artificial Sequence
  Synthetic polymer.
GFSSDDYTIG

SEQ ID NO: 262 - protein, 10 aa, Artificial Sequence
  Synthetic polymer.
GFSFDDYTIG

SEQ ID NO: 263 - protein, 10 aa, Artificial Sequence
  Synthetic polymer.
GFTFDDYAIA

SEQ ID NO: 264 - protein, 10 aa, Artificial Sequence
  Synthetic polymer.
GFTFDDYAIG

SEQ ID NO: 265 - protein, 10 aa, Artificial Sequence
  Synthetic polymer.
GFTFGDYTIG

SEQ ID NO: 266 - protein, 10 aa, Artificial Sequence
  Synthetic polymer.
EGTFSSYGIG

SEQ ID NO: 267 - protein, 10 aa, Artificial Sequence
  Synthetic polymer.
GFSSDDYTIG

SEQ ID NO: 268 - protein, 10 aa, Artificial Sequence
  Synthetic polymer.
GVSIGDYNIG

SEQ ID NO: 269 - protein, 10 aa, Artificial Sequence
  Synthetic polymer.
GFTFDDYTIA

SEQ ID NO: 270 - protein, 10 aa, Artificial Sequence
  Synthetic polymer.
GFTFDDYTIA

SEQ ID NO: 271 - protein, 11 aa, Artificial Sequence
  Synthetic polymer.
ASITWGGGNTY

SEQ ID NO: 272 - protein, 11 aa, Artificial Sequence
  Synthetic polymer.
AATVWTGAGTV

SEQ ID NO: 273 - protein, 11 aa, Artificial Sequence
  Synthetic polymer.
AAIGWSADITV

SEQ ID NO: 274 - protein, 11 aa, Artificial Sequence
  Synthetic polymer.
AFIDWSGGGTY

SEQ ID NO: 275 - protein, 11 aa, Artificial Sequence
  Synthetic polymer.
ATITWGGGSTY

SEQ ID NO: 276 - protein, 11 aa, Artificial Sequence
  Synthetic polymer.
AAISWSGGPTV

SEQ ID NO: 277 - protein, 11 aa, Artificial Sequence
  Synthetic polymer.
AAITWGGGSTV

SEQ ID NO: 278 - protein, 11 aa, Artificial Sequence
  Synthetic polymer.
AAITWSGVSTV

SEQ ID NO: 279 - protein, 11 aa, Artificial Sequence
  Synthetic polymer.
GAIMWSGAFTH

SEQ ID NO: 280 - protein, 11 aa, Artificial Sequence
  Synthetic polymer.
AAITWGGGSTV

SEQ ID NO: 281 - protein, 11 aa, Artificial Sequence
  Synthetic polymer.
SCISSSDRNTY

SEQ ID NO: 282 - protein, 11 aa, Artificial Sequence
  Synthetic polymer.
AFIDWSGGGTY

SEQ ID NO: 283 - protein, 11 aa, Artificial Sequence
  Synthetic polymer.
AVITWSGDSTY

SEQ ID NO: 284 - protein, 11 aa, Artificial Sequence
  Synthetic polymer.
ACISSKDGSTY

SEQ ID NO: 285 - protein, 11 aa, Artificial Sequence
  Synthetic polymer.
SGINSIGGSTT

SEQ ID NO: 286 - protein, 10 aa, Artificial Sequence
  Synthetic polymer.
AWTWSGDSTY

SEQ ID NO: 287 - protein, 10 aa, Artificial Sequence
  Synthetic polymer.
AKITNFGITS

SEQ ID NO: 288 - protein, 11 aa, Artificial Sequence
  Synthetic polymer.
SFISWISDITY

SEQ ID NO: 289 - protein, 11 aa, Artificial Sequence
  Synthetic polymer.
AFIDWSGGGTY

SEQ ID NO: 290 - protein, 11 aa, Artificial Sequence
  Synthetic polymer.
AVILWSGVSTY

SEQ ID NO: 291 - protein, 11 aa, Artificial Sequence
  Synthetic polymer.
AAIVWSGGSTY

SEQ ID NO: 292 - protein, 11 aa, Artificial Sequence
  Synthetic polymer.
AAISSSGYHTY

SEQ ID NO: 293 - protein, 11 aa, Artificial Sequence
  Synthetic polymer.
SCISSPDGSTY

SEQ ID NO: 294 - protein, 11 aa, Artificial Sequence
  Synthetic polymer.
AAVLWSGVSTA

SEQ ID NO: 295 - protein, 11 aa, Artificial Sequence
  Synthetic polymer.
VAITWDGSATT

SEQ ID NO: 296 - protein, 11 aa, Artificial Sequence
  Synthetic polymer.
AAIGWNGGITY

SEQ ID NO: 297 - protein, 11 aa, Artificial Sequence
  Synthetic polymer.
GFITWSGASTY

SEQ ID NO: 298 - protein, 11 aa, Artificial Sequence
  Synthetic polymer.
AGINWSGESAD

SEQ ID NO: 299 - protein, 11 aa, Artificial Sequence
  Synthetic polymer.
SCIERSDGSTY

SEQ ID NO: 300 - protein, 11 aa, Artificial Sequence
  Synthetic polymer.
SCISNTDSSTY

SEQ ID NO: 301 - protein, 11 aa, Artificial Sequence
  Synthetic polymer.
SCISNTDSSTY

SEQ ID NO: 302 - protein, 11 aa, Artificial Sequence
  Synthetic polymer.
AQISWSAGSIY

SEQ ID NO: 303 - protein, 11 aa, Artificial Sequence
  Synthetic polymer.
AGMSWNPGPAV

SEQ ID NO: 304 - protein, 11 aa, Artificial Sequence
  Synthetic polymer.
SCISRSDGSTY

SEQ ID NO: 305 - protein, 11 aa, Artificial Sequence
  Synthetic polymer.
ANIGWTGDMTY

SEQ ID NO: 306 - protein, 11 aa, Artificial Sequence
  Synthetic polymer.
AAIIWSGSMTY

SEQ ID NO: 307 - protein, 11 aa, Artificial Sequence
  Synthetic polymer.
SCISNTDSSTY

SEQ ID NO: 308 - protein, 11 aa, Artificial Sequence
  Synthetic polymer.
AANTWSGGPTY

SEQ ID NO: 309 - protein, 10 aa, Artificial Sequence
  Synthetic polymer.
SCISSDGSTG

SEQ ID NO: 310 - protein, 11 aa, Artificial Sequence
  Synthetic polymer.
SCYSSSDGSTG

SEQ ID NO: 311 - protein, 10 aa, Artificial Sequence
  Synthetic polymer.
SCISSDGSTG

SEQ ID NO: 312 - protein, 11 aa, Artificial Sequence
  Synthetic polymer.
GCIKSSDGTTG

SEQ ID NO: 313 - protein, 11 aa, Artificial Sequence
  Synthetic polymer.
SCISNTDSSTY

SEQ ID NO: 314 - protein, 11 aa, Artificial Sequence
  Synthetic polymer.
AAIAWSAGSTY

SEQ ID NO: 315 - protein, 11 aa, Artificial Sequence
  Synthetic polymer.
SCISSKEGSTY

SEQ ID NO: 316 - protein, 11 aa, Artificial Sequence
  Synthetic polymer.
SCISSSDGSTG

SEQ ID NO: 317 - protein, 11 aa, Artificial Sequence
  Synthetic polymer.
SCYSSRDGTTG

SEQ ID NO: 318 - protein, 10 aa, Artificial Sequence
  Synthetic polymer.
SCISSDGSTG

SEQ ID NO: 319 - protein, 11 aa, Artificial Sequence
  Synthetic polymer.
SCYSSSDGSTG

SEQ ID NO: 320 - protein, 11 aa, Artificial Sequence
  Synthetic polymer.
SCFSSSDGSTG

SEQ ID NO: 321 - protein, 11 aa, Artificial Sequence
  Synthetic polymer.
SCISNTDSSTF

SEQ ID NO: 322 - protein, 11 aa, Artificial Sequence
  Synthetic polymer.
SCYSSSDGSTG

SEQ ID NO: 323 - protein, 11 aa, Artificial Sequence
  Synthetic polymer.
SCISNTDSSTY

SEQ ID NO: 324 - protein, 11 aa, Artificial Sequence
  Synthetic polymer.
SCISSSDGSTG

SEQ ID NO: 325 - protein, 11 aa, Artificial Sequence
  Synthetic polymer.
GGINWSGDSTD

SEQ ID NO: 326 - protein, 11 aa, Artificial Sequence
  Synthetic polymer.
SCFSSSDGSAG

SEQ ID NO: 327 - protein, 11 aa, Artificial Sequence
  Synthetic polymer.
SCISNTDSSTY

SEQ ID NO: 328 - protein, 11 aa, Artificial Sequence
  Synthetic polymer.
SCFSTRDGNAG

SEQ ID NO: 329 - protein, 11 aa, Artificial Sequence
  Synthetic polymer.
SCFSSRDGSTG

SEQ ID NO: 330 - protein, 11 aa, Artificial Sequence
  Synthetic polymer.
SCFSSRDGSTG

SEQ ID NO: 331 - protein, 10 aa, Artificial Sequence
  Synthetic polymer.
SCISSDGSTG

SEQ ID NO: 332 - protein, 11 aa, Artificial Sequence
  Synthetic polymer.
SCISNTDSSTY

SEQ ID NO: 333 - protein, 11 aa, Artificial Sequence
  Synthetic polymer.
SCISSPDGSTY

SEQ ID NO: 334 - protein, 11 aa, Artificial Sequence
  Synthetic polymer.
SCYSSSDGNTG

SEQ ID NO: 335 - protein, 11 aa, Artificial Sequence
  Synthetic polymer.
GGINWSGDSTD

SEQ ID NO: 336 - protein, 11 aa, Artificial Sequence
  Synthetic polymer.
SCFSSSDGSTG

SEQ ID NO: 337 - protein, 11 aa, Artificial Sequence
  Synthetic polymer.
SCISSGDGTTY

SEQ ID NO: 338 - protein, 10 aa, Artificial Sequence
  Synthetic polymer.
SCISSDGSTG

SEQ ID NO: 339 - protein, 10 aa, Artificial Sequence
  Synthetic polymer.
SCISSDGSTG

SEQ ID NO: 340 - protein, 19 aa, Artificial Sequence
  Synthetic polymer.
AKGLRNSDWDLRRGYEYDY

SEQ ID NO: 341 - protein, 25 aa, Artificial Sequence
  Synthetic polymer.
ADQASVPPPYGSERYDIASPSEYDY

SEQ ID NO: 342 - protein, 21 aa, Artificial Sequence
  Synthetic polymer.
ANSRAYYSSSYDLGRLASYDY

SEQ ID NO: 343 - protein, 16 aa, Artificial Sequence
  Synthetic polymer.
AAQRLGSVTDYTKYDY

SEQ ID NO: 344 - protein, 20 aa, Artificial Sequence
  Synthetic polymer.
ASVKWAGSGIDISGSRNYDY

SEQ ID NO: 345 - protein, 21 aa, Artificial Sequence
  Synthetic polymer.
AKRLDYSATDKGVDLSDEYDY

SEQ ID NO: 346 - protein, 19 aa, Artificial Sequence
  Synthetic polymer.
AAGGSGRLRDLKVGQNYDY

SEQ ID NO: 347 - protein, 23 aa, Artificial Sequence
  Synthetic polymer.
ADSPPRTYSSGSVNLEDGSEYDY

SEQ ID NO: 348 - protein, 21 aa, Artificial Sequence
  Synthetic polymer.
VIPGRGSALPIDVGKSDEYEY

SEQ ID NO: 349 - protein, 19 aa, Artificial Sequence
  Synthetic polymer.
AAGASGRLRDLKVGQNYDY

SEQ ID NO: 350 - protein, 23 aa, Artificial Sequence
  Synthetic polymer.
ADGNVWSPPICGSAGPPPGGMDY

SEQ ID NO: 351 - protein, 16 aa, Artificial Sequence
  Synthetic polymer.
AAQRLGSVTDYTKYDY

SEQ ID NO: 352 - protein, 22 aa, Artificial Sequence
  Synthetic polymer.
AIPPRAYSGGSYSLKDQSKYEY

SEQ ID NO: 353 - protein, 23 aa, Artificial Sequence
  Synthetic polymer.
ADGNVWSPPICSSAGPPPGGMDY

SEQ ID NO: 354 - protein, 9 aa, Artificial Sequence
  Synthetic polymer.
KSRSSYSNN

SEQ ID NO: 355 - protein, 22 aa, Artificial Sequence
  Synthetic polymer.
AMPPRAYTGRSVSLKDQSKYEY

SEQ ID NO: 356 - protein, 13 aa, Artificial Sequence
  Synthetic polymer.
LDTTGWGPPPYQY

SEQ ID NO: 357 - protein, 22 aa, Artificial Sequence
  Synthetic polymer.
AHPPDPSRGGEWRLQTPSEYDY

SEQ ID NO: 358 - protein, 16 aa, Artificial Sequence
  Synthetic polymer.
AAQRLGSVTDYTKYDY

SEQ ID NO: 359 - protein, 24 aa, Artificial Sequence
  Synthetic polymer.
VPRSHFTTAQDMGQDMGAPSWYEY

SEQ ID NO: 360 - protein, 22 aa, Artificial Sequence
  Synthetic polymer.
AVLIRYYSGGYQGLSDANEYDY

SEQ ID NO: 361 - protein, 16 aa, Artificial Sequence
  Synthetic polymer.
WKYLSGSYSYAGQYNF

SEQ ID NO: 362 - protein, 23 aa, Artificial Sequence
  Synthetic polymer.
ADFNVWSPPICGSVGPPPGGMDY

SEQ ID NO: 363 - protein, 21 aa, Artificial Sequence
  Synthetic polymer.
AHESTYYSGTYYLTDPRRYVY

SEQ ID NO: 364 - protein, 19 aa, Artificial Sequence
  Synthetic polymer.
AVPARGLTMDLENSDIYDH

SEQ ID NO: 365 - protein, 22 aa, Artificial Sequence
  Synthetic polymer.
AATLQVTGSYYLDLSTVDIYDN

SEQ ID NO: 366 - protein, 20 aa, Artificial Sequence
  Synthetic polymer.
ATLFRSNGPKDLSSGYEYDY

SEQ ID NO: 367 - protein, 13 aa, Artificial Sequence
  Synthetic polymer.
AGESGVWVGGLDY

SEQ ID NO: 368 - protein, 22 aa, Artificial Sequence
  Synthetic polymer.
VGSANSGEFRFGWVLKPDLYNY

SEQ ID NO: 369 - protein, 23 aa, Artificial Sequence
  Synthetic polymer.
ADGNVWSPPICGSAGPPPGGMDY

SEQ ID NO: 370 - protein, 23 aa, Artificial Sequence
  Synthetic polymer.
ADGNVWSPPICGSAGPPPGGMDY

SEQ ID NO: 371 - protein, 20 aa, Artificial Sequence
  Synthetic polymer.
ERGYAYCSDDGCQRTQDYDY

SEQ ID NO: 372 - protein, 21 aa, Artificial Sequence
  Synthetic polymer.
GAARAWWSGSYDYTRMNNYDY

SEQ ID NO: 373 - protein, 23 aa, Artificial Sequence
  Synthetic polymer.
AETSADSGEFRFGWVLKPSLYDY

SEQ ID NO: 374 - protein, 21 aa, Artificial Sequence
  Synthetic polymer.
AAGSAYSGSYWNITMAANYDY

SEQ ID NO: 375 - protein, 18 aa, Artificial Sequence
  Synthetic polymer.
AQRIFGAQPMDLSGDYEY

SEQ ID NO: 376 - protein, 23 aa, Artificial Sequence
  Synthetic polymer.
ADGNVWSPPICGSAGPPPGGMDY

SEQ ID NO: 377 - protein, 18 aa, Artificial Sequence
  Synthetic polymer.
ARDYRGIKDLDLKGDYDY

SEQ ID NO: 378 - protein, 25 aa, Artificial Sequence
  Synthetic polymer.
ADFNVWSPPICGSIWYGPPPRGMDY

SEQ ID NO: 379 - protein, 25 aa, Artificial Sequence
  Synthetic polymer.
ADSNVWSPPICGSRWYGPPPGGMAY

SEQ ID NO: 380 - protein, 25 aa, Artificial Sequence
  Synthetic polymer.
ADFNVWSPPICGSNWYGPPPGGMDY

SEQ ID NO: 381 - protein, 25 aa, Artificial Sequence
  Synthetic polymer.
ADFNVWSPPICGSIWYGPPPGGMDY

SEQ ID NO: 382 - protein, 23 aa, Artificial Sequence
  Synthetic polymer.
ADGNVWSPPICGSAGPPPGGMDY

SEQ ID NO: 383 - protein, 17 aa, Artificial Sequence
  Synthetic polymer.
ARIITVATMRLDSDYDY

SEQ ID NO: 384 - protein, 23 aa, Artificial Sequence
  Synthetic polymer.
ADGNVWSPPICGSAGPPPGGMDY

SEQ ID NO: 385 - protein, 25 aa, Artificial Sequence
  Synthetic polymer.
ADSNVWSPPICGRTWYGPPPGGMDY

SEQ ID NO: 386 - protein, 25 aa, Artificial Sequence
  Synthetic polymer.
ADFNVWSPPICGSIWYGPPPGGMAY

SEQ ID NO: 387 - protein, 25 aa, Artificial Sequence
  Synthetic polymer.
ADFNVWSPPICGSNWYGPPPGGMDY

SEQ ID NO: 388 - protein, 25 aa, Artificial Sequence
  Synthetic polymer.
ADFNVWSPPICGSSWYGPPPGGMDY

SEQ ID NO: 389 - protein, 25 aa, Artificial Sequence
  Synthetic polymer.
ADFNVWSPPICGSRWYGPPPGGMEY

SEQ ID NO: 390 - protein, 23 aa, Artificial Sequence
  Synthetic polymer.
ADGNVWSPPICGSAGPPPGGMDY

SEQ ID NO: 391 - protein, 25 aa, Artificial Sequence
  Synthetic polymer.
ADFNVWSPPICGSRWYGPPPGGMAY

SEQ ID NO: 392 - protein, 23 aa, Artificial Sequence
  Synthetic polymer.
ADGNVWSPPICGSAGPPPGGMDY

SEQ ID NO: 393 - protein, 25 aa, Artificial Sequence
  Synthetic polymer.
ADSNVWSPPICGKTWYGPPPGGMDY

SEQ ID NO: 394 - protein, 13 aa, Artificial Sequence
  Synthetic polymer.
AGESGVWVGGLDY

SEQ ID NO: 395 - protein, 25 aa, Artificial Sequence
  Synthetic polymer.
ADSNVWSPPICGSTWYGPPPGGMAY

SEQ ID NO: 396 - protein, 23 aa, Artificial Sequence
  Synthetic polymer.
ADGNVWSPPICGSAGPPPGGMDY

SEQ ID NO: 397 - protein, 25 aa, Artificial Sequence
  Synthetic polymer.
ADFNVWSPPICGSRWYGPPPGGMDY

SEQ ID NO: 398 - protein, 25 aa, Artificial Sequence
  Synthetic polymer.
ADFNVWSPPICGSRWYGPPPGGMDY

SEQ ID NO: 399 - protein, 25 aa, Artificial Sequence
  Synthetic polymer.
ADFNVWSPPICGSRWYGPPPGGMDY

SEQ ID NO: 400 - protein, 25 aa, Artificial Sequence
  Synthetic polymer.
ADFNVWSPPICGSIWYGPPPGGMDY

SEQ ID NO: 401 - protein, 23 aa, Artificial Sequence
  Synthetic polymer.
ADGNVWSPPICGSAGPPPGGMDY

SEQ ID NO: 402 - protein, 23 aa, Artificial Sequence
  Synthetic polymer.
ADFNVWSPPICGSVGPPPGGMDY

SEQ ID NO: 403 - protein, 25 aa, Artificial Sequence
  Synthetic polymer.
ADFNVWSPPICGSSWYGPPPGGMAY

SEQ ID NO: 404 - protein, 13 aa, Artificial Sequence
  Synthetic polymer.
AGESGVWVGGLDY

SEQ ID NO: 405 - protein, 25 aa, Artificial Sequence
  Synthetic polymer.
ADFNVWSPPICGSSWYGPPPGGMEY

SEQ ID NO: 406 - protein, 23 aa, Artificial Sequence
  Synthetic polymer.
ADGNVWSPPICGSAGPPPGGMDY

SEQ ID NO: 407 - protein, 25 aa, Artificial Sequence
  Synthetic polymer.
ADFNVWSPPICSSNWYGPPPRGMDY

SEQ ID NO: 408 - protein, 25 aa, Artificial Sequence
  Synthetic polymer.
ADFNVWSPPICGSIWYGPPPRGMDY

SEQ ID NO: 409 - protein, 146 aa, Artificial Sequence
  Synthetic polymer.
QVQLQESGGGLVQAGGSLRLSCAASGRSFSSYTLAWFRQAPGKEREFVASITWGGGNTYYPDSVKGRFTISRDDAKNTVYLQMNSLKPEDTAVYYCAAKGLRNSDWDLRRGYEYDYWGQGTQVTVSSAAAYPYDVPDYGSHHHHHH

SEQ ID NO: 410 - protein, 152 aa, Artificial Sequence
  Synthetic polymer.
QVQLQESGGGLVQDGGSLRLSCAFSGRTFSSYTMGWFRQGPGKEREFVAATVWTGAGTVYADSVKGRFTISRDNAKNTVYLQMNSLRPEDTAVYYCAADQASVPPPYGSERYDIASPSEYDYWGQGTQVTVSSAAAYPYDVPDYGSHHHHHH

SEQ ID NO: 411 - protein, 148 aa, Artificial Sequence
  Synthetic polymer.
QVQLQESGGGLVQAGASLRLSCAASGRTFSSYIMGWFRQAPGKEREFVAAIGWSADITVYADSVKGRFTISRDNAENMVYLQMNSLNPEDTAVYYCAANSRAYYSSSYDLGRLASYDYWGQGTQVTVSSAAAYPYDVPDYGSHHHHHH

SEQ ID NO: 412 - protein, 143 aa, Artificial Sequence
  Synthetic polymer.
QVQLQESGGGLVQAGGSLRLSCAASGRTFSSYTMGWFRQAPGKEREFVAFIDWSGGGTYYDDSVKGRFTISRDNAENTVYLQMNNLEPEDTAVYYCAAAQRLGSVTDYTKYDYWGQGTQVTVSSAAAYPYDVPDYGSHHHHHH

SEQ ID NO: 413 - protein, 152 aa, Artificial Sequence
  Synthetic polymer.
QVQLQESGGGLVQAGGSLRLSCAASGRTSGRTFSSYTMGWFRQAPGKEREFVATITWGGGSTYYADSVKGRFTISRDNANNTVYLQMNSLKPEDTAVYYCAASVKVVAGSGIDISGSRNYDYWGQGTQVTVSSAAAYPYDVPDYGSHHHHHH

SEQ ID NO: 414 - protein, 148 aa, Artificial Sequence
  Synthetic polymer.
QVQLQESGGGLVQPGGSLRLSCLASGRTFSSYAMGWFRQAPGKEREFVAAISWSGGPTVYADHVKGRFTISRDNAKNTVYLQVNSLKPEDTADYYCAAKRLDYSATDKGVDLSDEYDYWGQGTQVTVSSAAAYPYDVPDYGSHHHHHH

SEQ ID NO: 415 - protein, 146 aa, Artificial Sequence
  Synthetic polymer.
QVQLQESGGGLVQAGDSLRLSCAASGLTFSNYIMGWFRQAPGKEREFVAAITWGGGSTVYADSVEGRFTISRDGTKNTVSLQMNSLLPEDTAVYYCAAAGGSGRLRDLKVGQNYDYWGQGTQVTVSSAAAYPYDVPDYGSHHHHHH

SEQ ID NO: 416 - protein, 150 aa, Artificial Sequence
  Synthetic polymer.
QVQLQESGGGLVQAGGSLRLSCAASGRTFSSYTMGWFRQAPGREREFVAAITWSGVSTVYTDSVKGRFTVSRDNAKNTVYLQMNSLKPEDTAVYYCAADSPPRTYSSGSVNLEDGSEYDYWGQGTQVTVSSAAAYPYDVPDYGSHHHHHH

SEQ ID NO: 417 - protein, 148 aa, Artificial Sequence
  Synthetic polymer.
QVQLQESGGGLVQAGGSLRLSCAASGRTFSSDTMGWFRQAPGKEREFVGAIMWSGAFTHYADSVKGRFTISRDNAKNTVYLQMNALKPEDTAVYYCAVIPGRGSALPIDVGKSDEYEYWGQGTQVTVSSAAAYPYDVPDYGSHHHHHH

SEQ ID NO: 418 - protein, 146 aa, Artificial Sequence
  Synthetic polymer.
QVQLQESGGGLVQAGDSLRLSCAASGLTFSNYIMGWFRQAPGKEREFVAAITWGGGSTVYADSVEGRFTISRDGTKNTVSLQMNSLQPEDTAVYYCAAAGASGRLRDLKVGQNYDYWGQGTQVTVSSAAAYPYDVPDYGSHHHHHH

SEQ ID NO: 419 - protein, 150 aa, Artificial Sequence
  Synthetic polymer.
QVQLQESGGGLVQAGGSLRLSCAGSGFTLDYYGIGWFRQAPGKEREGVSCISSSDRNTYYADSVKGRFTISGDNAKNTVYLQMNNLKPEDTAVYYCAADGNVWSPPICGSAGPPPGGMDYWGKGTQVTVSSAAAYPYDVPDYGSHHHHHH

SEQ ID NO: 420 - protein, 143 aa, Artificial Sequence
  Synthetic polymer.
QVQLQESGGGLVQAGGSLRLSCVASGHTFSSYTMGWFRQAPGKEREFVAFIDWSGGGTYYANSVKGRFTISRDNAENTVYLQMNNLKPEDTAVYYCAAAQRLGSVTDYTKYDYWGQGTQVTVSSAAAYPYDVPDYGSHHHHHH

SEQ ID NO: 421 - protein, 149 aa, Artificial Sequence
  Synthetic polymer.
QVQLQESGGGLVQAGGSLRLSCAASGRTFSSYVIGWFRQAPGKEREFVAVITWSGDSTYSSDSLKGRFTISRDNAKNTVYLQMNALNPEDTAVYYCAAIPPRAYSGGSYSLKDQSKYEYWGQGTQVTVSSAAAYPYDVPDYGSHHHHHH

SEQ ID NO: 422 - protein, 149 aa, Artificial Sequence
  Synthetic polymer.
QVQLQESGGGLVQAEGSLKLSCISGFAFDGYAIGWFRQAPGKEREGVACISSKDGSTYYADSVKGRFTMSVDKTKNTVYLQMSSLKPEDTAVYYCAADGNVWSPPICSSAGPPPGGMDYWGKGTQVTVSSAAAYPYDVPDYGSHHHHHH

SEQ ID NO: 423 - protein, 139 aa, Artificial Sequence
  Synthetic polymer.
QVQLQESGGGLVQPGGSLTLSCAASGFAFGFFDMTWVRQAPGKGLEWVSGINSIGGSTTYADSVKGRFTISRDNAKNELYLQMNSLKPDDTAVYYCAKSRSSYSNNWRPPGQGTQVTVSSAAAYPYDVPDYGSHHHHHH

SEQ ID NO: 424 - protein, 149 aa, Artificial Sequence
  Synthetic polymer.
QVQLQESGGGLVQARGSLTLSCAASGRTFSNYVIGWFRQAPGEEREFVAVVTWSGDSTYSSDSLKGRFTISRDNAKNTVYLQMNNLNPEDTAVYYCAAMPPRAYTGRSVSLKDQSKYEYWGQGTQVTVSSAAAYPYDVPDYGSHHHHHH

SEQ ID NO: 425 - protein, 139 aa, Artificial Sequence
  Synthetic polymer.
QVQLQESGGGLVQPGGSLRLSCAASGSIFSINVMGWYRQTPGKERELVAKITNFGITSYADSAQGRFTISRGNAKNTVYLQMNSLKPEDTAVYYCNLDTTGWGPPPYQYWGQGTQVTVSSAAAYPYDVPDYGSHHHHHH

SEQ ID NO: 426 - protein, 149 aa, Artificial Sequence
  Synthetic polymer.
QVQLQESGGGLVQAGASLRLSCAASGRTFSNYNVGWFRQAPGKEREFVSFISWISDITYYSDSVKGRFIISRDNAKNMVYLQMNSLKPEDTAVYYCAAHPPDPSRGGEWRLQTPSEYDYWGQGTQVTVSSAAAYPYDVPDYGSHHHHHH

SEQ ID NO: 427 - protein, 143 aa, Artificial Sequence
  Synthetic polymer.
QVQLQESGGGLVQAGGSLRLSCAASGHTFSSYTMGWFRQAPGKEREFVAFIDWSGGGTYYADSVKGRFTISRDNAENTVYLQMNNLKPEDTAVYYCAAAQRLGSVTDYTKYDYWGQGTQVTVSSAAAYPYDVPDYGSHHHHHH

SEQ ID NO: 428 - protein, 151 aa, Artificial Sequence
  Synthetic polymer.
QVQLQESGGGLVQAGGSLRLSCAASGRTFSTYPVGWFRQAPGKEREFVAVILWSGVSTYYADSVKGRFTISRDNAQNTVYLQMDSLKPEDTAVYYCAVPRSHFTTAQDMGQDMGAPSWYEYWGQGTQVTVSSAAAYPYDVPDYGSHHHHHH

SEQ ID NO: 429 - protein, 149 aa, Artificial Sequence
  Synthetic polymer.
QVQLQESGGGLVQAGGSLRLSCAASGRTFSNYAMGWFRQAPGKEREFVAAIVWSGGSTYYADSVKGRFTISRDNAKNTVYLQMNSLKPEDTAVYYCAAVLIRYYSGGYQGLSDANEYDYWGQGTQVTVSSAAAYPYDVPDYGSHHHHHH

SEQ ID NO: 430 - protein, 145 aa, Artificial Sequence
  Synthetic polymer.
QVQLQESGGGLVQAGASLRLSCSASGRTFSDYRMGWFRQAPGKEREIWVAAISSSGYHTYYADSVKGRFTISRDNAKNTGYLQMSSLKPEDTAVYYCAVVKYLSGSYSYAGQYNFWGQGTQVTVSSAAAYPYDVPDYGSHHHHHH

SEQ ID NO: 431 - protein, 150 aa, Artificial Sequence
  Synthetic polymer.
QVQLQESGGGLVQAGDSLKLSCAASGLTFSNYIMAWFRQAPGKEREGVSCISSPDGSTYYADSVKGRFTISSDNAKNTVYLQMNSLKPEDTAVYYCAADFNVWSPPICGSVGPPPGGMDYWGKGTQVTVSSAAAYPYDVPDYGSHHHHHH

SEQ ID NO: 432 - protein, 148 aa, Artificial Sequence
  Synthetic polymer.
QVQLQESGGGLVQAGGSLRLSCAASGRTFSNSVMGWFRQPPGKEREFVAAVLWSGVSTAYADSVKGRFTISRDNAKNTVYLQMNNLKPDDTAVYYCAAHESTYYSGTYYLTDPRRYVYWGQGTQVTVSSAAAYPYDVPDYGSHHHHHH

SEQ ID NO: 433 - protein, 146 aa, Artificial Sequence
  Synthetic polymer.
QVQLQESGGGLVQAGGSLRLSCVGDGRTFSSYLIGWFRQAPGNEREFVVAITWDGSATTYADSVKGRFTVSRDSAKNTAYLQMNSLKPEDTAVYYCAAVPARGLTMDLENSDIYDHWGRGTQVTVSSAAAYPYDVPDYGSHHHHHH

SEQ ID NO: 434 - protein, 149 aa, Artificial Sequence
  Synthetic polymer.
QVQLQESGGGLVQAGGSLRLSCAASGRTFSSYVMGWFRQALGKEREFVAAIGWNGGITYYADSVKGRFAISRDNAKNTVYLQMNSLKPEDTAVYYCAAATLQVTGSYYLDLSTVDIYDNWGQGTQVTVSSAAAYPYDVPDYGSHHHHHH

SEQ ID NO: 435 - protein, 147 aa, Artificial Sequence
  Synthetic polymer.
QVQLQESGGGLVQAGGSLRLSCAASGGTFSNYVMGWFRQAPGKEREFVGFITWSGASTYYADSVKGRFTISRDNAENTVYLQMNSLKPEDTAVYYCAATLFRSNGPKDLSSGYEYDYWGQGTQVTVSSAAAYPYDVPDYGSHHHHHH

SEQ ID NO: 436 - protein, 140 aa, Artificial Sequence
  Synthetic polymer.
  misc_feature (112)..(112): Xaa can be any naturally occurring amino acid
QVQLQESGGGLVQAGDSLRLTCTASGRTFSNYGIGWFRQAPGKEREFVAGINWSGESADYADSVKGRFTISRDNAKNTVYLQMNSLKPEDTAVYYCAAGESGVWVGGLDYWXQGTQVTVSSAAAYPYDVPDYGSHHHHHH

SEQ ID NO: 437 - protein, 149 aa, Artificial Sequence
  Synthetic polymer.
QVQLQESGGGLVQAGGSLRLSCAASGFTFDDYAIAWFRQAPGKEREGVSCIERSDGSTYYADSVKGRFTISSDNAKNTVYLQMNSLKPEDTAVYYCAVGSANSGEFRFGWVLKPDLYNYWGQGTQVTVSSAAAYPYDVPDYGSHHHHHH

SEQ ID NO: 438 - protein, 150 aa, Artificial Sequence
  Synthetic polymer.
QVQLQESGGGLVQAGGSLRLSCTASGRTFSSYTVAWFRQSPGKEREGISCISNTDSSTYYADSVKGRFTISSDNAKSTVHLQMSSLKPEDTAVYYCAADGNVWSPPICGSAGPPPGGMDYWGKGTQVTVSSAAAYPYDVPDYGSHHHHHH

SEQ ID NO: 439 - protein, 150 aa, Artificial Sequence
  Synthetic polymer.
QVQLQESGGGLVQPGGSLRLSCATFGFPFDDYAIAWFRQAPGKEREGVSCISNTDSSTYYADSVKGRFTISSDNAKNTVHLQMSSLKPEDTAVYYCAADGNVWSPPICGSAGPPPGGMDYWGKGTQVTVSSAAAYPYDVPDYGSHHHHHH

SEQ ID NO: 440 - protein, 147 aa, Artificial Sequence
  Synthetic polymer.
QVQLQESGGGLVQAGGSLRLSCAASGRTFSSYVMGWFRQAPGKEREFVAQISWSAGSIYYADSVKGRFTISNDNAKRTVYLQMNSLKPEDTAVYYCAERGYAYCSDDGCQRTQDYDYWGQGTQVTVSSAAAYPYDVPDYGSHHHHHH

SEQ ID NO: 441 - protein, 148 aa, Artificial Sequence
  Synthetic polymer.
QVQLQESGGGLVQAGGSLRLSCAASGRTLSSNPMAWFRQAAGKEREFVAGMSWNPGPAVYADSVKGRFTISRDSAENTVYLQMNSLKPEDTAVYYCAGAARAWWSGSYDYTRMNNYDYWGPGTQVTVSSAAAYPYDVPDYGSHHHHHH

SEQ ID NO: 442 - protein, 150 aa, Artificial Sequence
  Synthetic polymer.
QVQLQESGGGLVQAGGSLRLSCAVSGFTFDNYAIGWFRQAPGKEREGVSCISRSDGSTYYADSVRGRFTISSDNAKNTVYLQMNSLKPEDTAVYYCAAETSADSGEFRFGWVLKPSLYDYWGQGTQVTVSSAAAYPYDVPDYGSHHHHHH

SEQ ID NO: 443 - protein, 148 aa, Artificial Sequence
  Synthetic polymer.
QVQLQESGGGLVQAGGSLRLSCAASGRAFSSYFMGWFRQTPGKEREFVANIGWTGDMTYYADSVKGRFTISRDNAKNTVYLQMNSLKPEDTAVYYCAAAGSAYSGSYWNITMAANYDYWGQGTQVTVSSAAAYPYDVPDYGSHHHHHH

SEQ ID NO: 444 - protein, 145 aa, Artificial Sequence
  Synthetic polymer.
QVQLQESGGGLVQAGGSLRLSCAASTPTFSSYNMGWFRQAPGKEREFVAAIIWSGSMTYYADSMKGRFTVSIDNAKNTVYLQMNSLKPEDTAVYYCAAQRIFGAQPMDLSGDYEYWGQGTQVTVSSAAAYPYDVPDYGSHHHHHH

SEQ ID NO: 445 - protein, 150 aa, Artificial Sequence
  Synthetic polymer.
QVQLQESGGGLVQAGGSLRLSCATFGFTFDDYAIAWFRQAPGKEREGISCISNTDSSTYYADSVKGRFTISSDSAKNTVHLQMSSLKPEDTAVYYCAADGNVWSPPICGSAGPPPGGMDYWGKGTQVTVSSAAAYPYDVPDYGSHHHHHH

SEQ ID NO: 446 - protein, 145 aa, Artificial Sequence
  Synthetic polymer.
QVQLQESGGGLVQAGGSLRLSCKASGGTFSGYIMGWFRQAPGKEREFVAANTWSGGPTYYSDSVKGRFTISRDNAKNTVYLQMNTLKPEDTAVYQCAARDYRGIKDLDLKGDYDYWGQGTQVTVSSAAAYPYDVPDYGSHHHHHH

SEQ ID NO: 447 - protein, 151 aa, Artificial Sequence
  Synthetic polymer.
QVQLQESGGGLVQAGDSLKLSCATSGRSFSSYTIAWFRQAPGKEREGISCISSDGSTGYADSVRGRFTISSDNAKNTVYLQMNSLKPEDTAVYYCAADFNVWSPPICGSIWYGPPPRGMDYWGKGTQVTVSSAAAYPYDVPDYGSHHHHHH

SEQ ID NO: 448 - protein, 152 aa, Artificial Sequence
  Synthetic polymer.
QVQLQESGGGLVQAGGYLRLSCAASGFSSDDYTIGWFRQAPGKEREGISCYSSSDGSTGFADSVKGRFTISSDNAKNTVYLQMNNLRPEDTAVYYCAADSNVWSPPICGSRWYGPPPGGMAYWGKGTQVTVSSAAAYPYDVPDYGSHHHHHH

SEQ ID NO: 449 - protein, 151 aa, Artificial Sequence
  Synthetic polymer.
QVQLQESGGGLAQVGGSLRLSCTASGFTFDDYTIGWFRQAPGKEREGISCISSDGSTGYADSVKGRFTISSDNAKNTVYLQMNSLKPEDTAVYYCAADFNVWSPPICGSNWYGPPPGGMDYWGKGTQVTVSSAAAYPYDVPDYGSHHHHHH

SEQ ID NO: 450 - protein, 152 aa, Artificial Sequence
  Synthetic polymer.
QVQLQESGGGLVQAGGSLRLSCAASGFSSDDYTIGWFRQAPGKEREGIGCIKSSDGTTGYADSVKGRFTISSDNAKNTVYLQMNSLKPEDTAVYYCAADFNVWSPPICGSIWYGPPPGGMDYWGKGTQVTVSSAAAYPYDVPDYGSHHHHHH

SEQ ID NO: 451 - protein, 150 aa, Artificial Sequence
  Synthetic polymer.
QVQLQESGGGLAQAGGSLRLSCAASGFTFDQYTIAWFRQAPGKEREGVSCISNTDSSTYYADSVKGRFTISSDNAKNTVYLQMSSLKPEDTAVYYCAADGNVWSPPICGSAGPPPGGMDYWGKGTQVTVSSAAAYPYDVPDYGSHHHHHH

SEQ ID NO: 452 - protein, 144 aa, Artificial Sequence
  Synthetic polymer.
QVQLQESGGGLVQAGGSLRLSCAASGRTFSSYAMAWFRQAPGKEREFVAAIAWSAGSTYYADSVKGRFAISRDNAENTVYLQMNSLKPEDTAVYYCAARIITVATMRLDSDYDYWGQGTQVTVSSAAAYPYDVPDYGSHHHHHH

SEQ ID NO: 453 - protein, 150 aa, Artificial Sequence
  Synthetic polymer.
QVQLQESGGGLVQAGGSLRLSCAASGFAFDGYAIGWFRQAPGKEREGVSCISSKEGSTYYADSVKGRFTISSDNAKNTVYLQMSSLKPEDTAVYYCAADGNVWSPPICGSAGPPPGGMDYWGKGTQVTVSSAAAYPYDVPDYGSHHHHHH

SEQ ID NO: 454 - protein, 152 aa, Artificial Sequence
  Synthetic polymer.
QVQLQESGGGLVQAGGSLRLSCAASGFSSDDYTIAWFRRAPGKEREGISCISSSDGSTGYADSVKGRFTITSDSAKNTVYLQMNSLKPEDTAVYYCAADSNVWSPPICGRTWYGPPPGGMDYWGKGTQVTVSSAAAYPYDVPDYGSHHHHHH

SEQ ID NO: 455 - protein, 152 aa, Artificial Sequence
  Synthetic polymer.
QVQLQESGGGLVQPGGSLRLSCAASGFSSDDYTIGWFRQAPGKEREGISCYSSRDGTTGYADSVKGRFTISSDNAKNTVYLQMNSLKPEDTAVYYCAADFNVWSPPICGSIWYGPPPGGMAYWGQGTQVTVSSAAAYPYDVPDYGSHHHHHH

SEQ ID NO: 456 - protein, 151 aa, Artificial Sequence
  Synthetic polymer.
QVQLQESGGGLVQAGGSLRLSCAASGFTFDDYTIGWFRQAPGKEREGISCISSDGSTGYADSVKGRFTISSDNAKNTVYLQMNSLKPEDTAVYYCAADFNVWSPPICGSNWYGPPPGGMDYWGKGTQVTVSSAAAYPYDVPDYGSHHHHHH

SEQ ID NO: 457 - protein, 152 aa, Artificial Sequence
  Synthetic polymer.
QVQLQESGGGLVQAGGSLRLSCAASGFSSDDYTIGWFRQAPGKEREGISCYSSSDGSTGYADSVKGRFTISSDNAKNTVYLQMNSLKPEDTAVYYCAADFNVWSPPICGSSWYGPPPGGMDYWGKGTQVTVSSAAAYPYDVPDYGSHHHHHH

SEQ ID NO: 458 - protein, 152 aa, Artificial Sequence
  Synthetic polymer.
QVQLQESGGGLVQAGGSLRLSCAASGFSSDDYTIGWFRQAPGKEREGISCFSSSDGSTGFADSVKGRFTISSDNATNTVYLEMNSLKPEDTAVYYCAADFNVWSPPICGSRWYGPPPGGMEYWGKGTQVTVSSAAAYPYDVPDYGSHHHHHH

SEQ ID NO: 459 - protein, 150 aa, Artificial Sequence
  Synthetic polymer.
QVQLQESGGGLVQAGGSLRLSCATFGFSFDDYAIAWFRQAPGKEREGISCISNTDSSTFYADSVKGRFTISSDNAKNTVHLQMSSLKPEDTAVYYCAADGNVWSPPICGSAGPPPGGMDYWGKGTQVTVSSAAAYPYDVPDYGSHHHHHH

SEQ ID NO: 460 - protein, 152 aa, Artificial Sequence
  Synthetic polymer.
QVQLQESGGGLVQAGGSLRLSCAASGFSSDDYTIGWFRQAPGKEREGISCYSSSDGSTGFADSVKGRFTISSDNAKNTVYLQMNSLRPEDTAVYYCAADFNVWSPPICGSRWYGPPPGGMAYWGKGTQVTVSSAAAYPYDVPDYGSHHHHHH

SEQ ID NO: 461 - protein, 151 aa, Artificial Sequence
  Synthetic polymer.
QVQLQESGGGLVQVGGSLRLSCTISGFTGNDLAIGWFRQAPGKDQREGISCISNTDSSTYYADSVKGRFTISSDNAKNTVHLQMSSLKPEDTAVYYCAADGNVWSPPICGSAGPPPGGMDYWGKGTQVTVSSAAAYPYDVPDYGSHHHHHH

SEQ ID NO: 462 - protein, 152 aa, Artificial Sequence
  Synthetic polymer.
QVQLQESGGGLVQAGGSLRLSCAASGFSSDDYTIAWFRRAPGKEREGISCISSSDGSTGYADSVKGRFTISSDNAKNTVYLQMTSLKPEDTAVYYCAADSNVWSPPICGKTWYGPPPGGMDYWGKGTQVTVSSAAAYPYDVPDYGSHHHHHH

SEQ ID NO: 463 - protein, 140 aa, Artificial Sequence
  Synthetic polymer.
QVQLQESGGGLVQAGDSLRLSCAGSEGTLSSYGIGWFRQAPGKEREFVGGINWSGDSTDYADSVKGRFTISRDSAKNTVYLQMNSLKPEDTAVYYCAAGESGVWVGGLDYWGQGTQVTVSSAAAYPYDVPDYGSHHHHHH

SEQ ID NO: 464 - protein, 152 aa, Artificial Sequence
  Synthetic polymer.
QVQLQESGGGLVQAGGSLRLSCAASGFSSDDYTIAWFRRAPGKEREGISCFSSSDGSAGYADSVKGRFTVSSDNAKNTVYLQMNSLKPEDTAVYYCAADSNVWSPPICGSTWYGPPPGGMAYWGKGTQVTVSSAAAYPYDVPDYGSHHHHHH

SEQ ID NO: 465 - protein, 150 aa, Artificial Sequence
  Synthetic polymer.
QVQLQESGGGLVQAGGSLRLSCATSGFTFDDYAIAWFRQAPGKEREGVSCISNTDSSTYYADSVKGRFTISSDNAKNTVYLQMSSLKPEDTAVYYCAADGNVWSPPICGSAGPPPGGMDYWGKGTQVTVSSAAAYPYDVPDYGSHHHHHH

SEQ ID NO: 466 - protein, 152 aa, Artificial Sequence
  Synthetic polymer.
QVQLQESGGGLVQAGGSLRLSCEVSGLSSDDYTIGWFRQAPGKEREGFSCFSTRDGNAGYADSVKGRFTISSDNAKNTVYLQMNNLKPEDTAVYYCAADFNVWSPPICGSRWYGPPPGGMDYWGKGTQVTVSSAAAYPYDVPDYGSHHHHHH

SEQ ID NO: 467 - protein, 152 aa, Artificial Sequence
  Synthetic polymer.
QVQLQESGGGLVQAGGSLRLSCEVSGLSSDDYTIGWFRQAPGKKREGFSCFSSRDGSTGYADSVKGRFTISSDNAKNTVYLQMNSLKPEDTAVYYCAADFNVWSPPICGSRWYGPPPGGMDYWGKGTQVTVSSAAAYPYDVPDYGSHHHHHH

SEQ ID NO: 468 - protein, 152 aa, Artificial Sequence
  Synthetic polymer.
QVQLQESGGGLVQAGGSLRLSCAASGFSSDDYTIGWFRQAPGKEREGFSCFSSRDGSTGYADSVKGRFTISSDNAKNTVYLQMNSLKPEDTAVYYCAADFNVWSPPICGSRWYGPPPGGMDYWGKGTQVTVSSAAAYPYDVPDYGSHHHHHH

SEQ ID NO: 469 - protein, 151 aa, Artificial Sequence
  Synthetic polymer.
QVQLQESGGGLVQAGGSLRLSCAASGFSFDDYTIGWFRQVPGKEREGISCISSDGSTGYADSVKGRFTISSDNAKNTVYLQINSLKPEDTAVYYCAADFNVWSPPICGSIWYGPPPGGMDYWGKGTQVTVSSAAAYPYDVPDYGSHHHHHH

SEQ ID NO: 470 - protein, 150 aa, Artificial Sequence
  Synthetic polymer.
QVQLQESGGGLVQAGGSLRLSCATFGFTFDDYAIAWFRQAPGKEREGISCISNTDSSTYYADSVKGRFTISSDNAKNTVHLQMSSLKPEDTAVYYCAADGNVWSPPICGSAGPPPGGMDYWGKGTQVTVSSAAAYPYDVPDYGSHHHHHH

SEQ ID NO: 471 - protein, 150 aa, Artificial Sequence
  Synthetic polymer.
  misc_feature (19)..(19): Xaa can be any naturally occurring amino acid
QVQLQESGGGLVQAGGSLXLSCAASGFTFDDYAIGWFRQAPGKEREGVSCISSPDGSTYYADSVKGRFTISSDNAKNTVYLQMNSLKPEDTAVYYCAADFNVWSPPICGSVGPPPGGMDYWGKGTQVTVSSAAAYPYDVPDYGSHHHHHH

SEQ ID NO: 472 - protein, 152 aa, Artificial Sequence
  Synthetic polymer.
QVQLQESGGGLVQAGASLRLSCKASGFTFGDYTIGWFRQAPGKEREGISCYSSSDGNTGYADSVKGRFTISSDNAKNTVYLQMNSLRPEDTAVYYCAADFNVWSPPICGSSWYGPPPGGMAYWGKGTQVTVSSAAAYPYDVPDYGSHHHHHH

SEQ ID NO: 473 - protein, 140 aa, Artificial Sequence
  Synthetic polymer.
QVQLQESGGGLVQAGDSLRLSCAGSEGTFSSYGIGWFRQAPGKEREFVGGINWSGDSTDYADSVKGRFTISRDNAKNTVYLQMNSLKPEDTAVYYCAAGESGVWVGGLDYWGQGTQVTVSSAAAYPYDVPDYGSHHHHHH

SEQ ID NO: 474 - protein, 152 aa, Artificial Sequence
  Synthetic polymer.
QVQLQESGGGLVQAGGSLRLSCAASGFSSDDYTIGWFRQAPGKEREGISCFSSSDGSTGFADSVKGRFTISSDNATNTVYLQMNSLKPEDTAVYYCAADFNVWSPPICGSSWYGPPPGGMEYWGKGTQVTVSSAAAYPYDVPDYGSHHHHHH

SEQ ID NO: 475 - protein, 150 aa, Artificial Sequence
  Synthetic polymer.
QVQLQESGGGLVQAGDSLRLSCTASGVSIGDYNIGWFRQAPGKEREGVSCISSGDGTTYYTDSVKGRFTISTDNAKNTVYLQMNSLKPEDTAVYYCAADGNVWSPPICGSAGPPPGGMDYWGKGTQVTVSSAAAYPYDVPDYGSHHHHHH

SEQ ID NO: 476 - protein, 152 aa, Artificial Sequence
  Synthetic polymer.
QVQLQESGGGLVQAGGSLRLSCAASGFTFDDYTIAWFRQAPGGKEREGISCISSDGSTGYADSVKGRFTISSDNAKNMVYLQMNSLKPEDTALYYCAADFNVWSPPICSSNWYGPPPRGMDYWGKGTQVTVSSAAAYPYDVPDYGSHHHHHH

SEQ ID NO: 477 - protein, 151 aa, Artificial Sequence
  Synthetic polymer.
QVQLQESGGGLVQAGGSLRLSCAASGFTFDDYTIAWFRQAPGKEREGISCISSDGSTGYADSVRGRFTISSDNAKNTVYLQMNSLKPEDTAVYYCAADFNVWSPPICGSIWYGPPPRGMDYWGKGTQVTVSSAAAYPYDVPDYGSHHHHHH

SEQ ID NO: 478 - protein, 118 aa, Artificial Sequence
  Synthetic polymer.
EVQLVESGGGLVQPGGSLRLSCAASGFNIKDTYIHWVRQAPGKGLEWVARIDPANDNTLYASKFQGRATISADTSKNTAYLQMNSLRAEDTAVYYCGRGYGYYVFDHWGQGTLVTVSS

SEQ ID NO: 479 - protein, 118 aa, Artificial Sequence
  Synthetic polymer.
QVQLVQSGAEVKKPGATVKHSCKVSGFNHKDTYIHWVQQAPGKGLEWMGRHDPANDNTLYASKFQGRVTHTADTSTDTAYMELSSLRSEDTAVYYCARGYGYYVFDHWGQGTLVTVSS

SEQ ID NO: 480 - protein, 107 aa, Artificial Sequence
  Synthetic polymer.
DVQITQSPSSLSASVGDRVTITCRTSRSISQYLAWYQQKPGKVPKLLIYSGSTLQSGVPSRFSGSGSGTDFTLTISSLQPEDVATYYCQQHNENPLTFGGGTKVEIK

SEQ ID NO: 481 - protein, 10 aa, Artificial Sequence
  Synthetic polymer.
GFSMDYYAIA

SEQ ID NO: 482 - protein, 10 aa, Artificial Sequence
  Synthetic polymer.
GFSMDYYAIA

SEQ ID NO: 483 - protein, 10 aa, Artificial Sequence
  Synthetic polymer.
GFSVDYYAIA

SEQ ID NO: 484 - protein, 10 aa, Artificial Sequence
  Synthetic polymer.
GFSMDYYAIA

SEQ ID NO: 485 - protein, 10 aa, Artificial Sequence
  Synthetic polymer.
GGFNRVSYMG

SEQ ID NO: 486 - protein, 10 aa, Artificial Sequence
  Synthetic polymer.
GGFNRVSYMG

SEQ ID NO: 487 - protein, 10 aa, Artificial Sequence
  Synthetic polymer.
GIIKSINFMG

SEQ ID NO: 488 - protein, 10 aa, Artificial Sequence
  Synthetic polymer.
GFILDYYGIG

SEQ ID NO: 489 - protein, 10 aa, Artificial Sequence
  Synthetic polymer.
GLSLDYDGVG

SEQ ID NO: 490 - protein, 10 aa, Artificial Sequence
  Synthetic polymer.
GFILDYYGIG

SEQ ID NO: 491 - protein, 10 aa, Artificial Sequence
  Synthetic polymer.
GRTFSSLGMG

SEQ ID NO: 492 - protein, 10 aa, Artificial Sequence
  Synthetic polymer.
GRTFSSLGMG

SEQ ID NO: 493 - protein, 10 aa, Artificial Sequence
  Synthetic polymer.
GFAFGSYDMG

SEQ ID NO: 494 - protein, 10 aa, Artificial Sequence
  Synthetic polymer.
GFSFGNNDMS

SEQ ID NO: 495 - protein, 11 aa, Artificial Sequence
  Synthetic polymer.
CITGSDFMVDT

SEQ ID NO: 496 - protein, 11 aa, Artificial Sequence
  Synthetic polymer.
CITGSDFMVDT

SEQ ID NO: 497 - protein, 11 aa, Artificial Sequence
  Synthetic polymer.
CITGSDFMVDT

SEQ ID NO: 498 - protein, 11 aa, Artificial Sequence
  Synthetic polymer.
CITGSDFMVDT

SEQ ID NO: 499 - protein, 8 aa, Artificial Sequence
  Synthetic polymer.
SVTSGGEI

SEQ ID NO: 500 - protein, 8 aa, Artificial Sequence
  Synthetic polymer.
SVTSGGEI

SEQ ID NO: 501 - protein, 8 aa, Artificial Sequence
  Synthetic polymer.
STTSDGRT

SEQ ID NO: 502 - protein, 9 aa, Artificial Sequence
  Synthetic polymer.
CISSSDGST

SEQ ID NO: 503 - protein, 9 aa, Artificial Sequence
  Synthetic polymer.
CISSSDGST

SEQ ID NO: 504 - protein, 9 aa, Artificial Sequence
  Synthetic polymer.
CISSSDGST

SEQ ID NO: 505 - protein, 9 aa, Artificial Sequence
  Synthetic polymer.
AIAWNGAST

SEQ ID NO: 506 - protein, 9 aa, Artificial Sequence
  Synthetic polymer.
AIAWNGAST

SEQ ID NO: 507 - protein, 9 aa, Artificial Sequence
  Synthetic polymer.
GINSGGRIT

SEQ ID NO: 508 - protein, 9 aa, Artificial Sequence
  Synthetic polymer.
AINSGGGST

SEQ ID NO: 509 - protein, 19 aa, Artificial Sequence
  Synthetic polymer.
AVRSTANTLCPSHYSVMDY

SEQ ID NO: 510 - protein, 19 aa, Artificial Sequence
  Synthetic polymer.
AVRSTANTLCPSHYSIMDY

SEQ ID NO: 511 - protein, 19 aa, Artificial Sequence
  Synthetic polymer.
AVRSTANTLCPSHYSVMDY

SEQ ID NO: 512 - protein, 14 aa, Artificial Sequence
  Synthetic polymer.
NADIWVSDARMYNY

SEQ ID NO: 513 - protein, 14 aa, Artificial Sequence
  Synthetic polymer.
NADIWVSDARMYNY

SEQ ID NO: 514 - protein, 14 aa, Artificial Sequence
  Synthetic polymer.
NADIWLPSDRMYNY

SEQ ID NO: 515 - protein, 13 aa, Artificial Sequence
  Synthetic polymer.
ATATLCDGGIWGY

SEQ ID NO: 516 - protein, 13 aa, Artificial Sequence
  Synthetic polymer.
ATATLCDGGIWGY

SEQ ID NO: 517 - protein, 13 aa, Artificial Sequence
  Synthetic polymer.
ATATLCDGGIWGY

SEQ ID NO: 518 - protein, 16 aa, Artificial Sequence
  Synthetic polymer.
AASGLGSVWTANEYDY

SEQ ID NO: 519 - protein, 16 aa, Artificial Sequence
  Synthetic polymer.
AASGLGSVWTANEYDY

SEQ ID NO: 520 - protein, 15 aa, Artificial Sequence
  Synthetic polymer.
AQGDRSSWHYYGMDY

SEQ ID NO: 521 - protein, 13 aa, Artificial Sequence
  Synthetic polymer.
ATKSDPMTNEYDL

SEQ ID NO: 522 - protein, 147 aa, Artificial Sequence
  Synthetic polymer.
QVQLQESGGGLVQPGGSLRLSCAASGFSMDYYAIAWFRQAPGKEREEISCITGSDFMVDTYYVASVKGRFTISRDNAENTAYLQMNNLKPEDTGVYFCAVRSTANTLCPSHYSVMDYWGKGTQVTVSSAAAYPYDVPDYGSHHHHHH

SEQ ID NO: 523 - protein, 147 aa, Artificial Sequence
  Synthetic polymer.
QVQLQESGGGLVQAGGSLRLSCAASGFSMDYYAIAWFRQAPGKEREEISCITGSDFMVDTYYVASVKGRFTISRDNAENTAYLQMNNLKPEDTGVYFCAVRSTANTLCPSHYSVMDYWGKGTQVTVSSAAAYPYDVPDYGSHHHHHH

SEQ ID NO: 524 - protein, 146 aa, Artificial Sequence
  Synthetic polymer.
QVQLQESGGGLVQPGGSLRLSCSASGFSVDYYAIAWFRQAPGKEREEISCITGSDFMVDTYYVASVKGRFTISRDNAKNTAYLQMNSLKPEDTGVYFCAVRSTANTLCPSHYSIMDYWGKGTQVTVSSAAAYPYDVPDYGSHHHHH

SEQ ID NO: 525 - protein, 147 aa, Artificial Sequence
  Synthetic polymer.
QVQLQESGGGLVQPGGSLRLSCSASGFSMDYYAIAWFRQAPGKEREEISCITGSDFMVDTYYVASVKGRFTISRDNAKNTAHLQMNSLKPEDTGVYFCAVRSTANTLCPSHYSVMDYWGKGTQVTVSSAAAYPYDVPDYGSHHHHHH

SEQ ID NO: 526 - protein, 139 aa, Artificial Sequence
  Synthetic polymer.
QVQLQESGGGLVQAGGSLRLSCAASGGFNRVSYMGWYRQAPGTKRELVASVTSGGEITIADSVKGRFTVSRDNSKNTLYLQMNGLKPEDGATYWCNADIWVSDARMYNYWGQGTQVTVSSAAAYPYDVPDYGSHHHHHH

SEQ ID NO: 527 - protein, 139 aa, Artificial Sequence
  Synthetic polymer.
QVQLQESGGGLVQTGESLRLSCAASGGFNRVSYMGWYRQAPGSKRELVASVTSGGEITVADSVKGRFTVSRDNNKNTLYLQMNGLKPEDGATYWCNADIWVSDARMYNYWGQGTQVTVSSAAAYPYDVPDYGSHHHHHH

SEQ ID NO: 528 - protein, 139 aa, Artificial Sequence
  Synthetic polymer.
QVQLQESGGGLVQTGESLRLSCAASGIIKSINFMGWYRQPPGTKRELVASTTSDGRTTVADSVKGRFTISRDNAKNTIYLEMSSLKPEDTATYWCNADIWLPSDRMYNYWGQGTQVTVSSAAAYPYDVPDYGSHHHHHH

SEQ ID NO: 529 - protein, 139 aa, Artificial Sequence
  Synthetic polymer.
QVQLQESGGGLVQAGGSLRLSCAVSGFILDYYGIGWFRQAPGKEREAVSCISSSDGSTYYADSVKGRFTISRDNALNTLYLQMNSLKPEDTAVYHCATATLCDGGIWGYWGQGTQVTVSSAAAYPYDVPDYGSHHHHHH

SEQ ID NO: 530 - protein, 139 aa, Artificial Sequence
  Synthetic polymer.
QVQLQESGGGLAQAGGSLRLSCEGSGLSLDYDGVGWFRQAPGKEREAVSCISSSDGSTYYADSVKGRFTISRGNALNTLYLQMNSLKPEDTAVYYCATATLCDGGIWGYWGQGTQVTVSSAAAYPYDVPDYGSHHHHHH

SEQ ID NO: 531 - protein, 139 aa, Artificial Sequence
  Synthetic polymer.
QVQLQESGGGSVQPGGSLRLSCAVSGFILDYYGIGWFRQAPGKEREAVSCISSSDGSTYYADSVKGRFTISRDNALNTLYLQMNSLKPEDTAVYYCATATLCDGGIWGYWGQGTQVTVSSAAAYPYDVPDYGSHHHHHH

SEQ ID NO: 532 - protein, 143 aa, Artificial Sequence
  Synthetic polymer.
QVQLQESGGGSVQAGDSLRLSCTASGRTFSSLGMGWFRQAPGKEREFVSAIAWNGASTYYTESVKGRFTISRDDAKNTVYLQMNSLKPTDTAVYFCAASGLGSVVVTANEYDYWGQGTQVTVSSAAAYPYDVPDYGSHHHHHH

SEQ ID NO: 533 - protein, 143 aa, Artificial Sequence
  Synthetic polymer.
QVQLQESGGGSVQPGKSLRLSCAASGRTFSSLGMGWFRQAPGKEREFVSAIAWNGASTYYTESVKGRFTISRDDAKNTVYLQMNSLKPTDTAVYFCAASGLGSVVVTANEYDYWGQGTQVTVSSAAAYPYDVPDYGSHHHHHH

SEQ ID NO: 534 - protein, 141 aa, Artificial Sequence
  Synthetic polymer.
QVQLQESGGGLVQPGGSLRLSCTTSGFAFGSYDMGWVRQAPGKGPEWVSGINSGGRITDYADSVTGRFTISRDNAKNTLYLQMNSLKPEDTAVYYCAQGDRSSWHYYGMDYWGKGTQVTVSSAAAYPYDVPDYGSHHHHHH

SEQ ID NO: 535 - protein, 139 aa, Artificial Sequence
  Synthetic polymer.
  misc_feature (112)..(112): Xaa can be any naturally occurring amino acid
QVQLQESGGGLVQPGGSLRLSCAASGFSFGNNDMSWVRQAPGKGPEWVSAINSGGGSTYYADSVKGRFTISRDNAKNTLYLQMNSLKPEDTAVYYCATKSDPMTNEYDLWGXGTQVTVSSAAAYPYDVPDYGSHHHHHH

SEQ ID NO: 536 - protein, 447 aa, Artificial Sequence
  Synthetic polymer.
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 537 - protein, 218 aa, Artificial Sequence
  Synthetic polymer.
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 538 - protein, 440 aa, Artificial Sequence
  Synthetic polymer.
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 539 - protein, 214 aa, Artificial Sequence
  Synthetic polymer.
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 540 - protein, 106 aa, Artificial Sequence
  Synthetic polymer.
EIVLTQSPSSLSASVGDRVTITCSARSSVSYMHWYQQKPGKAPKLLIYRTSNLASGVPSRFSGSGSGTDFTLTINSLQPEDFATYYCQQRSSFPLTFGGGTKLEIK

SEQ ID NO: 541 - protein, 106 aa, Artificial Sequence
  Synthetic polymer.
EIVLTQSPSSLSASVGDRVTITCSARSSVSYMHWFQQKPGKAPKLWIYRTSNLASGVPSRFSGSGSGTDYTLTINSLQPEDFATYYCQQRSSFPLTFGGGTKLEIK

SEQ ID NO: 542 - protein, 106 aa, Artificial Sequence
  Synthetic polymer.
EIVLTQSPSSLSASVGDRVTITCSARSSVSYMHWFQQKPGKAPKLWIYRTSNLASGVPSRFSGSGSGTDYCLTINSLQPEDFATYYCQQRSSFPLTFGGGTKLEIK

SEQ ID NO: 543 - protein, 106 aa, Artificial Sequence
  Synthetic polymer.
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIK

SEQ ID NO: 544 - protein, 117 aa, Artificial Sequence
  Synthetic polymer.
QVQLVQSGSELKKPGASVKISCKASGYSFSNYGMNWVRQAPGQGLQWMGWINTDSGESTYAEEFKGRFVFSLDTSVSTAYLQITSLTAEDTGMYFCAKVGYDALDYWGQGTLVTVSS

SEQ ID NO: 545 - protein, 117 aa, Artificial Sequence
  Synthetic polymer.
QVQLVQSGSELKKPGASVKISCKASGYTFTNYGMNWVRQAPGQGLQWMGWINTDSGESTYAEEFKGRFVFSLDTSVSTAYLQITSLTAEDTGMYFCAKVGYDALDYWGQGTLVTVSS

SEQ ID NO: 546 - protein, 117 aa, Artificial Sequence
  Synthetic polymer.
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 547 - protein, 117 aa, Artificial Sequence
  Synthetic polymer.
QIQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 548 - protein, 117 aa, Artificial Sequence
  Synthetic polymer.
QIQLVQSGSELKKPGASVKISCKASGYTFTNYGMNWVKQAPGQGLKWMGWINTDSGESTYAEEFKGRFAFSLDTSVNTAYLQITSLNAEDTGMYFCVRVGYDALDYWGQGTLVTVSS

SEQ ID NO: 549 - protein, 106 aa, Artificial Sequence; identical to SEQ ID NO: 543
  Synthetic polymer.

SEQ ID NO: 550 - protein, 117 aa, Artificial Sequence; identical to SEQ ID NO: 546
  Synthetic polymer.

SEQ ID NO: 551 - protein, 254 aa, Artificial Sequence
  Synthetic polymer.
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCITAFTFIATVIALRKQLCQKLYSSKDTTKRPVTTTKREVNSAI

SEQ ID NO: 552 - protein, 453 aa, Artificial Sequence
  Synthetic polymer.
MIFLLLMLSLELQLHQTAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 553 - protein, 29 aa, Artificial Sequence
  Synthetic polymer.
SNTSESFKSNTSESFFRVTQLAPKAQIKE

SEQ ID NO: 554 - protein, 119 aa, Artificial Sequence
  Synthetic polymer.
EVQLQQSGPVLVKPGASVKMSCKASGYTFTDYYMNWVKQSHGKSLEWIGNINPYNGGTTYNQKFKGKATLTVDKSSRTAYMEINSLTSEDSAVYYCARGRIYDGSLDYWGQGTALTVSS

SEQ ID NO: 555 - protein, 106 aa, Artificial Sequence
  Synthetic polymer.
DIQMTQFPSSLCASQGGKVTVTCKASQDINNYMAWYQHKPGKGPRLLIHYTSTLLSGIPSRFSGSGSGRDYSFSISNLEPEDIATYYCLQYDNLWTFGGGTKLEIK

SEQ ID NO: 556 - protein, 116 aa, Artificial Sequence
  Synthetic polymer.
QVQLQQSGAELAKPGASVRLSCKASGYTFTNYWMHWVKQRPGQGLEWIGHINPSSGFTTYNQNFKDKATLTADKSSNTAYMQLSSLTYEDSAVYFCAREDYDVDYWGQGTTLTVSS

SEQ ID NO: 557 - protein, 107 aa, Artificial Sequence
  Synthetic polymer.
DIVMTQSQKFMSTSVGDRVSVTCKASQSVDTNVAWYQQKPGQSPKALIFSASYRYSGVPDRFTGSGSGTDFTLTINSVQSEDLAEYFCQQYNSYPYTFGSGTKLEIK

SEQ ID NO: 558 - protein, 122 aa, Artificial Sequence
  Synthetic polymer.
EVQLVESGGGLVKPGGSLKLSCAASGFTFSDYGMHWVRQAPEKGLEWVAYISSGSYTIYYTDTVKGRFTISRDNAKNTLFLQMTSLRSEDTAMYYCARRGYGSFYEYYFDYWGQGTTLTVSS

SEQ ID NO: 559 - protein, 106 aa, Artificial Sequence
  Synthetic polymer.
QIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIK

SEQ ID NO: 560 - protein, 119 aa, Artificial Sequence
  Synthetic polymer.
EVQLVESGGGLVQAGKSLRLSCAASGSIFSIHAMGWFRQAPGKEREFVAAITWSGGITYYEDSVKGRFTISRDNAKNTVYLQMNSLKPEDTAIYYCAADRAESSWYDYWGQGTQVTVSS

SEQ ID NO: 561 - protein, 119 aa, Artificial Sequence
  Synthetic polymer.
EVQLVESGGGLVQAGGSLRLSCAASGSIASIHAMGWFRQAPGKEREFVAVITWSGGITYYADSVKGRFTISRDNAKNTVYLQMNSLKPEDTAIYYCAGDKHQSSWYDYWGQGTQVTVSS

SEQ ID NO: 562 - protein, 119 aa, Artificial Sequence
  Synthetic polymer.
EVQLVESGGGLVQAGGSLRLSCAASGSISSIHAMGWFRQAPGKEREFVAAITWSGGITYYADSLKGRFTISRDNAKNTGYLQMNSLKPEDTAIYYCAADRAQSSWYDYWGQGTQVTVSS

SEQ ID NO: 563 - protein, 119 aa, Artificial Sequence
  Synthetic polymer.
EVQLVESGGGLVQAGGSLGLSCAASGSIFSINAMAWFRQAPGKEREFVALISWSGGSTYYEDSVKGRFTISRDNAKNTVYLQMNSLKPEDTAIYYCAADRVDSNWYDYWGQGTQVTVSS

SEQ ID NO: 564 - protein, 120 aa, Artificial Sequence
  Synthetic polymer.
EVQLVESGGGLVQAGGSLRLSCAASGRAFSSGTMGWFRRAPGKEREFVASIPWSGGRIYYADSVKGRFTISRDNAQNTVYLQMNSLKPEDTAVYYCAVKERSTGWDFASWGQCTQVTVSS

SEQ ID NO: 565 - protein, 121 aa, Artificial Sequence
  Synthetic polymer.
QVQLVQSGAELKQPGASVKMSCKASGYSFTSSWIHWVKQAPGQGLEWIGYIYPSTGFTEYNQKFKDRATLTADKSTSTAYMELSSLRSEDSAVYYCARWRDSSGYHAMDYWGQGTSVTVSS

SEQ ID NO: 566 - protein, 121 aa, Artificial Sequence
  Synthetic polymer.
QVQLVQSGAEVKQPGASVKMSCKASGYSFTSSWIHWVKQAPGQGLEWIGYIYPSTGFTEYNQKFKDRATLTADKSTSTAYMELSSLRSEDTAVYYCARWRDSSGYHAMDYWGQGTSVTVSS

SEQ ID NO: 567 - protein, 121 aa, Artificial Sequence
  Synthetic polymer.
QVQLVQSGHEVKQPGASVKMSCKASGYSFTSSWIHWVKQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 568 - protein, 121 aa, Artificial Sequence
  Synthetic polymer.
QVQLVQSGHEVKQPGASVKMSCKASGYSFTSSWIHWVRQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 569 - protein, 121 aa, Artificial Sequence
  Synthetic polymer.
QVQLVQSGHEVKQPGASVKVSCKASGYSFTSSWIHWVRQAPGQGLEWIGYIYPSTGFTEYNQKFKDRATITADKSTSTAYMELSSLRSEDTAVYYCARWRDSSGYHAMDYWGQGTLVTVSS

SEQ ID NO: 570 - protein, 111 aa, Artificial Sequence
  Synthetic polymer.
DIVLTQSPASLTLSPGQRLTISCRASQSVSTSGYSYMHWYQQKPDQSPKLLIKFGSNLESGIPARFSGSGSGTDFTLTISSLEEEDFATYYCQHSWEIPYTFGQGTKLEIK

SEQ ID NO: 571 - protein, 111 aa, Artificial Sequence
  Synthetic polymer.
DIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 572 - protein, 111 aa, Artificial Sequence
  Synthetic polymer.
EIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 573 - protein, 111 aa, Artificial Sequence
  Synthetic polymer.
DIVLTQSPATLSLSPGQRLTISCRASQSVSTSGYSYMHWYQQKPDQSPKLLIKFGSNLESGIPARFSGSGSGTDFTLTISSLEPEDFAVYYCQHSWEIPYTFGQGTKLEIK

SEQ ID NO: 574 - protein, 10 aa, Artificial Sequence
  Synthetic polymer.
GFTLDYYAIG

SEQ ID NO: 575 - protein, 10 aa, Artificial Sequence
  Synthetic polymer.
GTIFSINHMD

SEQ ID NO: 576 - protein, 10 aa, Artificial Sequence
  Synthetic polymer.
GFTFDDYGMS

SEQ ID NO: 577 - protein, 10 aa, Artificial Sequence
  Synthetic polymer.
GFTLDYYAIN

SEQ ID NO: 578 - protein, 10 aa, Artificial Sequence
  Synthetic polymer.
GTIFSINRMD

SEQ ID NO: 579 - protein, 10 aa, Artificial Sequence
  Synthetic polymer.
GFTFSSYGMS

SEQ ID NO: 580 - protein, 10 aa, Artificial Sequence
  Synthetic polymer.
GKIFSGNDMG

SEQ ID NO: 581 - protein, 10 aa, Artificial Sequence
  Synthetic polymer.
GTIFSINRMD

SEQ ID NO: 582 - protein, 10 aa, Artificial Sequence
  Synthetic polymer.
GFTFSSYGMS

SEQ ID NO: 583 - protein, 10 aa, Artificial Sequence
  Synthetic polymer.
GFTFNDYAMS

SEQ ID NO: 584 - protein, 10 aa, Artificial Sequence
  Synthetic polymer.
GFNLDPYAIA

SEQ ID NO: 585 - protein, 10 aa, Artificial Sequence
  Synthetic polymer.
GFTFTAYAMS

SEQ ID NO: 586 - protein, 10 aa, Artificial Sequence
  Synthetic polymer.
GFTFDYYAIG

SEQ ID NO: 587 - protein, 10 aa, Artificial Sequence
  Synthetic polymer.
GFNLDPYAIA

SEQ ID NO: 588 - protein, 10 aa, Artificial Sequence
  Synthetic polymer.
GTIFSINRMD

SEQ ID NO: 589 - protein, 10 aa, Artificial Sequence
  Synthetic polymer.
GTIFSINRMD

SEQ ID NO: 590 - protein, 10 aa, Artificial Sequence
  Synthetic polymer.
GFTFSSYGMS

SEQ ID NO: 591 - protein, 10 aa, Artificial Sequence
  Synthetic polymer.
GFNLDPYAIG

SEQ ID NO: 592 - protein, 10 aa, Artificial Sequence
  Synthetic polymer.
GFNLDPYAIA

SEQ ID NO: 593 - protein, 10 aa, Artificial Sequence
  Synthetic polymer.
ESIFSIEAMG

SEQ ID NO: 594 - protein, 10 aa, Artificial Sequence
  Synthetic polymer.
GKIFSGNDMG

SEQ ID NO: 595 - protein, 10 aa, Artificial Sequence
  Synthetic polymer.
GFTLDYYAIG

SEQ ID NO: 596 - protein, 10 aa, Artificial Sequence
  Synthetic polymer.
GFTFSSYGMS

SEQ ID NO: 597 - protein, 10 aa, Artificial Sequence
  Synthetic polymer.
GTIFSINRMD

SEQ ID NO: 598 - protein, 10 aa, Artificial Sequence
  Synthetic polymer.
GFTFSSYGMS

SEQ ID NO: 599 - protein, 10 aa, Artificial Sequence
  Synthetic polymer.
GFNLDPYAIA

SEQ ID NO: 600 - protein, 10 aa, Artificial Sequence
  Synthetic polymer.
GRTFSISAMG

SEQ ID NO: 601 - protein, 10 aa, Artificial Sequence
  Synthetic polymer.
GFTLDYYAIN

SEQ ID NO: 602 - protein, 10 aa, Artificial Sequence
  Synthetic polymer.
GFTFSSYGMS

SEQ ID NO: 603 - protein, 10 aa, Artificial Sequence
  Synthetic polymer.
GFTFNDYAMS

SEQ ID NO: 604 - protein, 10 aa, Artificial Sequence
  Synthetic polymer.
GFTLDYYAIG

SEQ ID NO: 605 - protein, 9 aa, Artificial Sequence
  Synthetic polymer.
ISSSDGSTY

SEQ ID NO: 606 - protein, 8 aa, Artificial Sequence
  Synthetic polymer.
ITSDGFPT

SEQ ID NO: 607 - protein, 9 aa, Artificial Sequence
  Synthetic polymer.
IRWNGGSTN

SEQ ID NO: 608 - protein, 9 aa, Artificial Sequence
  Synthetic polymer.
ISSSDGSTY

SEQ ID NO: 609 - protein, 8 aa, Artificial Sequence
  Synthetic polymer.
ITSDGTPT

SEQ ID NO: 610 - protein, 9 aa, Artificial Sequence
  Synthetic polymer.
IDSGGGSTS

SEQ ID NO: 611 - protein, 8 aa, Artificial Sequence
  Synthetic polymer.
ITSGGITD

SEQ ID NO: 612 - protein, 8 aa, Artificial Sequence
  Synthetic polymer.
ITSDGTPT

SEQ ID NO: 613 - protein, 9 aa, Artificial Sequence
  Synthetic polymer.
IDSGGGSTS

SEQ ID NO: 614 - protein, 9 aa, Artificial Sequence
  Synthetic polymer.
IRSNGGYTN

SEQ ID NO: 615 - protein, 9 aa, Artificial Sequence
  Synthetic polymer.
ISSSDVGTY

SEQ ID NO: 616 - protein, 9 aa, Artificial Sequence
  Synthetic polymer.
INSSDGSTY

SEQ ID NO: 617 - protein, 9 aa, Artificial Sequence
  Synthetic polymer.
ISGSDSSTY

SEQ ID NO: 618 - protein, 9 aa, Artificial Sequence
  Synthetic polymer.
ISSSDVGTY

SEQ ID NO: 619 - protein, 8 aa, Artificial Sequence
  Synthetic polymer.
ITSDGTPT

SEQ ID NO: 620 - protein, 8 aa, Artificial Sequence
  Synthetic polymer.
ITSDGTPA

SEQ ID NO: 621 - protein, 9 aa, Artificial Sequence
  Synthetic polymer.
IDSGGGSTS

SEQ ID NO: 622 - protein, 9 aa, Artificial Sequence
  Synthetic polymer.
ISSGDGSKY

SEQ ID NO: 623 - protein, 9 aa, Artificial Sequence
  Synthetic polymer.
ISSSDVGTY

SEQ ID NO: 624 - protein, 8 aa, Artificial Sequence
  Synthetic polymer.
IFGGGFTN

SEQ ID NO: 625 - protein, 8 aa, Artificial Sequence
  Synthetic polymer.
ITSGGITD

SEQ ID NO: 626 - protein, 9 aa, Artificial Sequence
  Synthetic polymer.
ISSSDGSTY

SEQ ID NO: 627 - protein, 9 aa, Artificial Sequence
  Synthetic polymer.
IDSGGGSTS

SEQ ID NO: 628 - protein, 8 aa, Artificial Sequence
  Synthetic polymer.
ITSDGTPT

SEQ ID NO: 629 - protein, 9 aa, Artificial Sequence
  Synthetic polymer.
IDSGGGSTS

SEQ ID NO: 630 - protein, 9 aa, Artificial Sequence
  Synthetic polymer.
ISSSDVGTY

SEQ ID NO: 631 - protein, 9 aa, Artificial Sequence
  Synthetic polymer.
ITWSGGSTS

SEQ ID NO: 632 - protein, 9 aa, Artificial Sequence
  Synthetic polymer.
ISSSDGSTY

SEQ ID NO: 633 - protein, 9 aa, Artificial Sequence
  Synthetic polymer.
IDSGGGSTS

SEQ ID NO: 634 - protein, 9 aa, Artificial Sequence
  Synthetic polymer.
IRSNGGYTN

SEQ ID NO: 635 - protein, 9 aa, Artificial Sequence
  Synthetic polymer.
ISSSDGSTY

SEQ ID NO: 636 - protein, 16 aa, Artificial Sequence
  Synthetic polymer.
DGWSSCRHGINEYLYW

SEQ ID NO: 637 - protein, 8 aa, Artificial Sequence
  Synthetic polymer.
SSGVYNYW

SEQ ID NO: 638 - protein, 12 aa, Artificial Sequence
  Synthetic polymer.
QGYYCSGYGCPR

SEQ ID NO: 639 - protein, 17 aa, Artificial Sequence
  Synthetic polymer.
SGWRLCRPTDEYDYSYW

SEQ ID NO: 640 - protein, 8 aa, Artificial Sequence
  Synthetic polymer.
SSGVYNYW

SEQ ID NO: 641 - protein, 14 aa, Artificial Sequence
  Synthetic polymer.
QGYYCSGYGCSDYW

SEQ ID NO: 642 - protein, 7 aa, Artificial Sequence
  Synthetic polymer.
RDRTIWW

SEQ ID NO: 643 - protein, 8 aa, Artificial Sequence
  Synthetic polymer.
SSGVYNYW

SEQ ID NO: 644 - protein, 14 aa, Artificial Sequence
  Synthetic polymer.
QGYYCSGYGCSDYW

SEQ ID NO: 645 - protein, 12 aa, Artificial Sequence
  Synthetic polymer.
QGYYCSGYGCYP

SEQ ID NO: 646 - protein, 15 aa, Artificial Sequence
  Synthetic polymer.
DGYYYCSDYPHPLYW

SEQ ID NO: 647 - protein, 15 aa, Artificial Sequence
  Synthetic polymer.
DGWRDCTWSNEYAYW

SEQ ID NO: 648 - protein, 15 aa, Artificial Sequence
  Synthetic polymer.
TGWRTCRGLNEYDYW

SEQ ID NO: 649 - protein, 15 aa, Artificial Sequence
  Synthetic polymer.
DGYYYCSDYPHPLYW

SEQ ID NO: 650 - protein, 8 aa, Artificial Sequence
  Synthetic polymer.
SSGVYNYW

SEQ ID NO: 651 - protein, 8 aa, Artificial Sequence
  Synthetic polymer.
SSGVYNYW

SEQ ID NO: 652 - protein, 14 aa, Artificial Sequence
  Synthetic polymer.
QGYYCSGYGCSDYW

SEQ ID NO: 653 - protein, 15 aa, Artificial Sequence
  Synthetic polymer.
DGYYYCSDYPHPLYW

SEQ ID NO: 654 - protein, 15 aa, Artificial Sequence
  Synthetic polymer.
DGYYYCSDYPHPLYW

SEQ ID NO: 655 - protein, 13 aa, Artificial Sequence
  Synthetic polymer.
DLVSGSSRLYDYW

SEQ ID NO: 656 - protein, 7 aa, Artificial Sequence
  Synthetic polymer.
RDRTIWW

SEQ ID NO: 657 - protein, 16 aa, Artificial Sequence
  Synthetic polymer.
DGWSSCRHGINEYLYW

SEQ ID NO: 658 - protein, 14 aa, Artificial Sequence
  Synthetic polymer.
QGYYCSGYGCSDYW

SEQ ID NO: 659 - protein, 8 aa, Artificial Sequence
  Synthetic polymer.
SSGVYNYW

SEQ ID NO: 660 - protein, 14 aa, Artificial Sequence
  Synthetic polymer.
QGYYCSGYGCSDYW

SEQ ID NO: 661 - protein, 15 aa, Artificial Sequence
  Synthetic polymer.
DGYYYCSDYPHPLYW

SEQ ID NO: 662 - protein, 18 aa, Artificial Sequence
  Synthetic polymer.
MGRTNYGVIYDPNMYNYW

SEQ ID NO: 663 - protein, 17 aa, Artificial Sequence
  Synthetic polymer.
SGWRLCRPTDEYDYLYW

SEQ ID NO: 664 - protein, 14 aa, Artificial Sequence
  Synthetic polymer.
QGYYCSGYGCSDYW

SEQ ID NO: 665 - protein, 12 aa, Artificial Sequence
  Synthetic polymer.
QGYYCSGYGCYP

SEQ ID NO: 666 - protein, 16 aa, Artificial Sequence
  Synthetic polymer.
DGWSSCRHGINEYLYW

SEQ ID NO: 667 - protein, 143 aa, Artificial Sequence
  Synthetic polymer.
QVQLQESGGGLVQAGGSLRLSCAASGFTLDYYAIGWFRQAPGKEREEVSCISSSDGSTYYADSVKGRFTISRDNAKNTVNLQMNSLKPEDTAVYYCATDGWSSCRHGINEYLYWGQGTQVTVSSAAAYPYDVPDYGSHHHHHH

SEQ ID NO: 668 - protein, 134 aa, Artificial Sequence
  Synthetic polymer.
QVQLQESGGGLVQAGGSLRLSCTASGTIFSINHMDWFRQAPGKQRELVALITSDGFPTYADSAKGRFTISRDNTKKTVSLQMNSLKPEDTAVYYCHVSSGVYNYWGQGTQVTVSSAAAYPYDVPDYGSHHHHHH

SEQ ID NO: 669 - protein, 138 aa, Artificial Sequence
  Synthetic polymer.
QVQLQESGGGLVQPGGSLRLSCAASGFTFDDYGMSWVRQAPGKGLEWVSAIRWNGGSTNYADSVKGRFTISRDNAKNTLYLQMNSLKSEDTAVYYCAQGYYCSGYGCPRGQGTQVTVSSAAAYPYDVPDYGSHHHHHH

SEQ ID NO: 670 - protein, 144 aa, Artificial Sequence
  Synthetic polymer.
QVQLQESGGGLVQPGGSLRLSCAASGFTLDYYAINWFRQAPGKEREEVSCISSSDGSTYYADSVKGRFTISRDNAKNTVYLQMNSLKPEDTAVYYCATSGWRLCRPTDEYDYSYWGQGTQVTVSSAAAYPYDVPDYGSHHHHHH

SEQ ID NO: 671 - protein, 134 aa, Artificial Sequence
  Synthetic polymer.
QVQLQESGGGVVQAGGSLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 672 - protein, 140 aa, Artificial Sequence
  Synthetic polymer.
QVQLQESGGGLVQTGGSLRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 673 - protein, 133 aa, Artificial Sequence
  Synthetic polymer.
QVQLQESGGGLVQPGGSLRLSCAASGKIFSGNDMGWYRQAPGKQRELVGIITSGGITDYADAVKGRFTISRDNAKNMMYLQMNSLKPEDTAVYYCNMRDRTIWWGQGTQVTVSSAAAYPYDVPDYGSHHHHHH

SEQ ID NO: 674 - protein, 134 aa, Artificial Sequence
  Synthetic polymer.
QVQLQESGGGSVQAGGSLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 675 - protein, 140 aa, Artificial Sequence
  Synthetic polymer.
QVQLQESGGGLVQPGGSLRLSCAASGFTFSSYGMSWVRQTPGKGPEWVSAIDSGGGSTSYADSVKGRFTTSRDNAKNTLYLQMNSLKPEDTAVYYCAQGYYCSGYGCSDYWGQGTQVTVSSAAAYPYDVPDYGSHHHHHH

SEQ ID NO: 676 - protein, 138 aa, Artificial Sequence
  Synthetic polymer.
QVQLQESGGGLVQPGGSLRLSCAASGFTFNDYAMSWVRQAPGKGLEWVSGIRSNGGYTNYADSVKGRFTISRDNAKNTLYLQMNSLKSEDTAVYYCAQGYYCSGYGCYPGQGTQVTVSSAAAYPYDVPDYGSHHHHHH

SEQ ID NO: 677 - protein, 142 aa, Artificial Sequence
  Synthetic polymer.
QVQLQESGGGLVQAGGSLRLSCAASGFNLDPYAIAWFRQAPGKEREEVSCISSSDVGTYYADSVKGRFTISRDNAKKTVYLQMNSLKPEDTAVYYCATDGYYYCSDYPHPLYWGQGTQVTVSSAAAYPYDVPDYGSHHHHHH

SEQ ID NO: 678 - protein, 142 aa, Artificial Sequence
  Synthetic polymer.
QVQLQESGGGLVQPGGSLRLSCAASGFTFTAYAMSWFRQAPGKEREEVSCINSSDGSTYYADSVKGRFTISRDNAKNTVYLQMNSLKPEDTAVYHCATDGWRDCTWSNEYAYWGQGTQVTVSSAAAYPYDVPDYGSHHHHHH

SEQ ID NO: 679 - protein, 142 aa, Artificial Sequence
  Synthetic polymer.
QVQLQESGGGLVQPGGSLRLSCAASGFTFDYYAIGWFRQAPGKEREEVSCISGSDSSTYYADSVKGRFTIVRDNAQNTVYLQMNSLKPEDTAIYYCAVTGWRTCRGLNEYDYWGQGTQVTVSSAAAYPYDVPDYGSHHHHHH

SEQ ID NO: 680 - protein, 142 aa, Artificial Sequence
  Synthetic polymer.
QVQLQESGGGLVQPGGSLRLSCAASGFNLDPYAIAWFRQAPGKEREEVSCISSSDVGTYYADSVKGRFTISRDNTKKTVYLQMNSLKPEDTAVYYCATDGYYYCSDYPHPLYWGQGTQVTVSSAAAYPYDVPDYGSHHHHHH

SEQ ID NO: 681 - protein, 134 aa, Artificial Sequence
  Synthetic polymer.
QVQLQESGGGLVQAGESLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 682 - protein, 134 aa, Artificial Sequence
  Synthetic polymer.
QVQLQESGGGLVQAGGSLRLSCTASGTIFSINRMDWFRQAPGKQRELVALITSDGTPAYADSAKGRFTISRDNTKKTVSLQMNSLKPEDTAVYYCHVSSGVYNYWGQGTQVTVSSAAAYPYDVPDYGSHHHHHH

SEQ ID NO: 683 - protein, 140 aa, Artificial Sequence
  Synthetic polymer.
QVQLQESGGGLVQSGGSLRLSCKTSGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 684 - protein, 142 aa, Artificial Sequence
  Synthetic polymer.
QVQLQESGGGLVQPGGSLRLSCAASGFNLDPYAIGWFRQAPGKEREEVSCISSGDGSKYYADSVKGRFTMSRDNAKKTVYLQMNSLKPEDTAVYYCATDGYYYCSDYPHPLYWGQGTQVTVSSAAAYPYDVPDYGSHHHHHH

SEQ ID NO: 685 - protein, 142 aa, Artificial Sequence
  Synthetic polymer.
QVQLQESGGGLVQPGGSLRLSCAVSGFNLDPYAIAWFRQAPGKEREEVSCISSSDVGTYYADSVKGRFTISRDNAKKTVYLQMNSLKPEDTAVYYCATDGYYYCSDYPHPLYWGQGTQVTVSSAAAYPYDVPDYGSHHHHHH

SEQ ID NO: 686 - protein, 139 aa, Artificial Sequence
  Synthetic polymer.
QVQLQESGGGLVQAGGSLRLSCAASESIFSIEAMGWYRQAPGKQRELVAAIFGGGFTNYADSVKGRFTISRDNANRTVYLQMNSLKPEDTAVYYCNADLVSGSSRLYDYWGQGTQVTVSSAAAYPYDVPDYGSHHHHHH

SEQ ID NO: 687 - protein, 133 aa, Artificial Sequence
  Synthetic polymer.
QVQLQESGGGLVQAGGSLRLSCAASGKIFSGNDMGWYRQAPGKQRELVGIITSGGITDYADAVKGRFTISRDNAKNMMYLQMNSLKPEDTAVYYCNMRDRTIWWGQGTQVTVSSAAAYPYDVPDYGSHHHHHH

SEQ ID NO: 688 - protein, 143 aa, Artificial Sequence
  Synthetic polymer.
QVQLQESGGGLVQPGGSLRLSCAASGFTLDYYAIGWFRQAPGKEREEVSCISSSDGSTYYADSVKGRFTISRDNAKNTVNLQMNSLKPEDTAVYYCATDGWSSCRHGINEYLYWGQGTQVTVSSAAAYPYDVPDYGSHHHHHH

SEQ ID NO: 689 - protein, 140 aa, Artificial Sequence
  Synthetic polymer.
QVQLQESGGGLVQAGGSLRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 690 - protein, 134 aa, Artificial Sequence
  Synthetic polymer.
QVQLQESGGGLVQPGGSLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 691 - protein, 140 aa, Artificial Sequence
  Synthetic polymer.
QVQLQESGGGLVQPGGSLRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 692 - protein, 142 aa, Artificial Sequence
  Synthetic polymer.
QVQLQESGGGLVQPGGSLRLSCAASGFNLDPYAIAWFRQAPGKEREEVSCISSSDVGTYYADSVKGRFTISRDNAKKTVYLQMNSLKPEDTAVYYCATDGYYYCSDYPHPLYWGQGTQVTVSSAAAYPYDVPDYGSHHHHHH

SEQ ID NO: 693 - protein, 145 aa, Artificial Sequence
  Synthetic polymer.
  misc_feature (13)..(13): Xaa can be any naturally occurring amino acid
QVQLQESGGGLVXAGGSLRLSCAASGRTFSISAMGWFRQAPGKEREFVAAITWSGGSTSYTDSVKGRFTISRDNAKNTLYLQMNSLKPEDTAIYYCAAMGRTNYGVIYDPNMYNYWGQGTQVTVSSAAAYPYDVPDYGSHHHHHH

SEQ ID NO: 694 - protein, 144 aa, Artificial Sequence
  Synthetic polymer.
QVQLQESGGGLVQPGGSLRLSCAASGFTLDYYAINWFRQAPGKEREEVSCISSSDGSTYYADSVKGRFTISRDNAKNTVYLQMNSLKPEDTAVYYCATSGWRLCRPTDEYDYLYWGQGTQVTVSSAAAYPYDVPDYGSHHHHHH

SEQ ID NO: 695 - protein, 140 aa, Artificial Sequence
  Synthetic polymer.
QVQLQESGGGLVQAGGSMRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 696 - protein, 138 aa, Artificial Sequence
  Synthetic polymer.
QVQLQESGGGTVQAGGSLRLSCAASGFTFNDYAMSWVRQAPGKGLEWVSGIRSNGGYTNYADSVKGRFTISRDNAKNTLYLQMNSLKSEDTAVYYCAQGYYCSGYGCYPGQGTQVTVSSAAAYPYDVPDYGSHHHHHH

SEQ ID NO: 697 - protein, 143 aa, Artificial Sequence
  Synthetic polymer.
QVQLQESGGGLVQPGTSLRLSCAASGFTLDYYAIGWFRQAPGKEREEVSCISSSDGSTYYADSVKGRFTISRDNAKNTVNLQMNSLKPEDTAVYYCATDGWSSCRHGINEYLYWGQGTQVTVSSAAAYPYDVPDYGSHHHHHH

SEQ ID NO: 698 - protein, 451 aa, Artificial Sequence
  Synthetic polymer.
EVQLVESGGGIKQDGSEKYYGWFGELAFDYKDYFPEPVTVTYICNVNHKPPKDTLMISRTNSTYRVVSVLQVYTLPPSREVLDSDGSFFLLVQPGGSLRLVDSVKGRFTIWGQGTLVTVSSWNSGALTSGSNTKVDKRVEPEVTCVVVDVTVLHQDWLNGEMTKNQVSLTYSKLTVDKSRSCAASGFTFSSRDNAKNSLYSASTKGPSVFVHTFPAVLQSPKSCDKTHTCSHEDPEVKFNKEYKCKVSNKCLVKGFYPSDWQQGNVFSCSRYWMSWVRQALQMNSLRAEDPLAPSSKSTSSGLYSLSSVVPPCPAPEFEGWYVDGVEVHNALPASIEKTIIAVEWESNGQVMHEALHNHYPGKGLEWVANTAVYYCAREGGGTAALGCLVTVPSSSLGTQGPSVFLFPPKAKTKPREEQYSKAKGQPREPPENNYKTTPPTQKSLSLSPGK

SEQ ID NO: 699 - protein, 215 aa, Artificial Sequence
  Synthetic polymer.
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 700 - protein, 118 aa, Artificial Sequence
  Synthetic polymer.
EVKLQESGPSLVKPSQTLSLTCSVTGYSIISDYWNWIRKFPGNKLEYLGYISYTGSTYYNPSLKSRISITRDTSKNQYYLQLNSVTTEDTATYYCARRGGWLLPFDYWGQGTTLTVSS

SEQ ID NO: 701 - protein, 113 aa, Artificial Sequence
  Synthetic polymer.
DIVMTQSPSSLAVSVGEKVSMGCKSSQSLLYSSNQKNSLAWYQQKPGQSPKLLIDWASTRESGVPDRFTGSGSGTDFTLTISSVKAEDLAVYYCQQYYGYPLTFGAGTKLELK

SEQ ID NO: 702 - protein, 118 aa, Artificial Sequence
  Synthetic polymer.
EVKLQESGPSLVKPGASVKLSCKASGYTFTSYDINWVKQRPGQGLEWIGWIFPRDNNTKYNENFKGKATLTVDTSSTTAYMELHSLTSEDSAVYFCTKENWVGDFDYWGQGTTLTLSS

SEQ ID NO: 703 - protein, 106 aa, Artificial Sequence
  Synthetic polymer.
DIVMTQSPAIMSASPGEKVTMTCSASSSIRYMHWYQQKPGTSPKRWISDTSKLTSGVPARFSGSGSGTSYALTISSMEAEDAATYYCHQRSSYPWTFGGGTKLEIK

SEQ ID NO: 704 - protein, 114 aa, Artificial Sequence
  Synthetic polymer.
EVQLQQSGPDLVTPGASVRISCQASGYTFPDYYMNWVKQSHGKSLEWIGDIDPNYGGTTYNQKFKGKAILTVDRSSSTAYMELRSLTSEDSAVYYCARGALTDWGQGTSLTVSS

SEQ ID NO: 705 - protein, 106 aa, Artificial Sequence
  Synthetic polymer.
QIVLSQSPAILSASPGEKVTMTCRASSSVSYIYWFQQKPGSSPKPWIYATFNLASGVPARFSGSGSGTSYSLTISRVETEDAATYYCQQWSNNPLTFGAGTKLELK

SEQ ID NO: 706 - protein, 115 aa, Artificial Sequence
  Synthetic polymer.
EVQLVQSGPELKKPGASVKMSCKASGYTFTSYVMHWVKQAPGQRLEWIGYVNPFNDGTKYNEMFKGRATLTSDKSTSTAYMELSSLRSEDSAVYYCARQAWGYPWGQGTLVTVSS

SEQ ID NO: 707 - protein, 115 aa, Artificial Sequence
  Synthetic polymer.
EVQLVQSGAEVKKPGASVKMSCKASGYTFTSYVMHWVKQAPGQRLEWIGYVNPFNDGTKYNEMFKGRATLTSDKSTSTAYMELSSLRSEDTAVYYCARQAWGYPWGQGTLVTVSS

SEQ ID NO: 708 - protein, 115 aa, Artificial Sequence
  Synthetic polymer.
EVQLVQSGAEVKKPGASVKMSCKASGYTFTSYVMHWVRQAPGQRLEWIGYVNPFNDGTKYNEMFKGRATLTSDKSTSTAYMELSSLRSEDTAVYYCARQAWGYPWGQGTLVTVSS

SEQ ID NO: 709 - protein, 115 aa, Artificial Sequence
  Synthetic polymer.
EVQLVQSGAEVKKPGASVKVSCKASGYTFTSYVMHWVRQAPGQRLEWIGYVNPFNDGTKYNEMFKGRATLTSDKSTSTAYMELSSLRSEDTAVYYCARQAWGYPWGQGTLVTVSS

SEQ ID NO: 710 - protein, 115 aa, Artificial Sequence
  Synthetic polymer.
EVQLVQSGAEVKKPGASVKVSCKASGYTFTSYVMHWVRQAPGQRLEWIGYVNPFNDGTKYNEMFKGRATITSDKSTSTAYMELSSLRSEDTAVYYCARQAWGYPWGQGTLVTVSS

SEQ ID NO: 711 - protein, 111 aa, Artificial Sequence
  Synthetic polymer.
DIVLTQSPASLALSPGERATLSCRATESVEYYGTSLVQWYQQKPGQPPKLLIYAASSVDSGVPSRFSGSGSGTDFTLTINSLEEEDAAMYFCQQSRRVPYTFGQGTKLEIK

SEQ ID NO: 712 - protein, 111 aa, Artificial Sequence
  Synthetic polymer.
DIVLTQSPATLSLSPGERATLSCRATESVEYYGTSLVQWYQQKPGQPPKLLIYAASSVDSGVPSRFSGSGSGTDFTLTINSLEAEDAAMYFCQQSRRVPYTFGQGTKLEIK

SEQ ID NO: 713 - protein, 111 aa, Artificial Sequence
  Synthetic polymer.
EIVLTQSPATLSLSPGERATLSCRATESVEYYGTSLVQWYQQKPGQPPKLLIYAASSVDSGVPSRFSGSGSGTDFTLTINSLEAEDAAMYFCQQSRRVPYTFGQGTKLEIK

SEQ ID NO: 714 - protein, 111 aa, Artificial Sequence
  Synthetic polymer.
DIVLTQSPATLSLSPGERATLSCRATESVEYYGTSLVQWYQQKPGQPPKLLIYAASSVDSGVPSRFSGSGSGTDFTLTINSLEAEDAATYFCQQSRRVPYTFGQGTKLEIK

SEQ ID NO: 715 - protein, 120 aa, Artificial Sequence
  Synthetic polymer.
EVQLVESGGGLVKPGGSLRLSCAASGFTFSTYSMNWVRQAPGKGLEWVSSISSSGDYIYYADSVKGRFTISRDNAKNSLFLQMNSLKAEDTAVYYCARDLVTSMVAFDYWGQGTLVTVSS

SEQ ID NO: 716 - protein, 108 aa, Artificial Sequence
  Synthetic polymer.
SYELTQPPSVSVSPGQAARITCSGDALPQKYVFWYQQKSGQAPVLVIYEDSKRPSGIPERFSGSSSGTMATLTISGAQVEDEADYYCYSTDRSGNHRVFGGGTRLTVL

SEQ ID NO: 717 - protein, 120 aa, Artificial Sequence
  Synthetic polymer.
EVQLVESGGGLVQPGGSLRLSCAASGFTFSSYWMSWVRQAPGKGLEWVANIKQDGGEQYYVDSVKGRFTISRDNAKNSLYLQMNSLRAEDTAVYYCARDWNYGYYDMDVWGQGTTVTVSS

SEQ ID NO: 718 - protein, 108 aa, Artificial Sequence
  Synthetic polymer.
EIVLTQSPGTLSLSPGERATLSCRASQSVSSNYLAWFQQKPGQAPRLLIFGTSSRATGIPDRFSGSGSGTDFTLTISRLEPEDFAVYYCQQYGSSIFTFGPGTKVDIK

SEQ ID NO: 719 - protein, 121 aa, Artificial Sequence
  Synthetic polymer.
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 720 - protein, 108 aa, Artificial Sequence
  Synthetic polymer.
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTEVEIK

SEQ ID NO: 721 - protein, 121 aa, Artificial Sequence
  Synthetic polymer.
EVQLLESGGGLVQPGGSLRLSCAASGFTFSNYAMSWVRQAPGKGLEWVSAIRGSGGSTYYADSVKGRFTISRDNSKNTLYLQMNSLRAEDTAVYYCAKDLHYDSSGYLDYWGQGTLVTVSS

SEQ ID NO: 722 - protein, 107 aa, Artificial Sequence
  Synthetic polymer.
DIQMTQSPSSVSASVGDRVTITCRASQGIRSWLAWYQQKPGKAPKLLIYAISRLQSGVPSRFSGSGSGTDFTLTISSLQPEDFATYYCQQANSFPLTFGGGTKVEIK

SEQ ID NO: 723 - protein, 119 aa, Artificial Sequence
  Synthetic polymer.
EVQLVESGGGLVQPGGSLRLSCAASGFTFSSYWMSWVRQAPGKGLEWVANIKQDGGEKYYVDSVKGRFTISRDNAKNSLFLQMNSLRAEDTAVYYCARVQLYSDYFDYWGQGTLVTVSS

SEQ ID NO: 724 - protein, 107 aa, Artificial Sequence
  Synthetic polymer.
DIQMTQSPSSVSASVGDRVTITCRASQGISSWLAWYQQKSGKAPKLLIYAASGLQSGVPSRFSGSGSGTDFTLTISSLQPEDLATYYCQQSHSLPPTFGQGTKVEIK

SEQ ID NO: 725 - protein, 121 aa, Artificial Sequence
  Synthetic polymer.
EVQLLESGGDLVQPGGSLRLSCAASGFTFNSYAMSWVRQAPGKGLEWVSTISGSGGFTFSADSVKGRFTISRDNSKNTLFLQMNSLRVEDSAVYSCAKVLVGFNNGCWDYWGQGTLVTVSS

SEQ ID NO: 726 - protein, 108 aa, Artificial Sequence
  Synthetic polymer.
SYVLTQPPSVSVAPGQTARITCGGNNIGSKSVHWYQQKPGQAPVLVVYDDSDRPSGIPERFSGSNSGNTATLTISRVEAGDEADYYCQVWDSSNDHVVFGGGTKLTVL

SEQ ID NO: 727 - protein, 120 aa, Artificial Sequence
  Synthetic polymer.
EVQLVESGGGLVKPGGSLRLSCAASGFTFSTYSMNWVRQAPGKGLEWVSSISSSGDYIYYADSVKGRFTISRDNAKNSLYLQMNSLRAEDTAVYYCARDLVTSMVAFDYWGQGTLVTVSS

SEQ ID NO: 728 - protein, 108 aa, Artificial Sequence
  Synthetic polymer.
SYELTQPPSVSVSPGQTARITCSGDALPQKYVFWYQQKSGQAPVLVIYEDSKRPSGIPERFSGSSSGTMATLTISGAQVEDEADYYCYSTDRSGNHRVFGGGTKLTVL

SEQ ID NO: 729 - protein, 121 aa, Artificial Sequence; identical to SEQ ID NO: 719
  Synthetic polymer.

SEQ ID NO: 730 - protein, 108 aa, Artificial Sequence
  Synthetic polymer.
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 731 - protein, 120 aa, Artificial Sequence
  Synthetic polymer.
QVQLVQSGAEVKKPGASVKVSCKASGYTFTSYWMYWVRQATGQGLEWMGRIDPNSGSTKYNEKFKNRFTISRDDSKNTAYLQMNSLKTEDTAVYYCARDYRKGLYAMDYWGQGTTVTVSS

SEQ ID NO: 732 - protein, 120 aa, Artificial Sequence
  Synthetic polymer.
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSS

SEQ ID NO: 733 - protein, 120 aa, Artificial Sequence
  Synthetic polymer.
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQGTTVTVSS

SEQ ID NO: 734 - protein, 120 aa, Artificial Sequence
  Synthetic polymer.
EVQLVQSGAEVKKPGATVKISCKVSGYTFTSYWMYWIRQSPSRGLEWLGRIDPNSGSTKYNEKFKNRLTISKDTSKNQVVLTMTNMDPVDTATYYCARDYRKGLYAMDYWGQGTTVTVSS

SEQ ID NO: 735 - protein, 120 aa, Artificial Sequence
  Synthetic polymer.
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQGTTVTVSS

SEQ ID NO: 736 - protein, 120 aa, Artificial Sequence
  Synthetic polymer.
QVQLVQSGAEVKKPGASVKVSCKASGYTFTSYWMYWIRQSPSRGLEWLGRIDPNSGSTKYNEKFKNRFTISRDDSKNTAYLQMNSLKTEDTAVYYCARDYRKGLYAMDYWGQGTTVTVSS

SEQ ID NO: 737 - protein, 120 aa, Artificial Sequence
  Synthetic polymer.
EVQLVQSGAEVKKPGESLRISCKGSGYTFTSYWMYWVRQARGQRLEWIGRIDPNSGSTKYNEKFKNRLTISKDTSKNQVVLTMTNMDPVDTATYYCARDYRKGLYAMDYWGQGTTVTVSS

SEQ ID NO: 738 - protein, 120 aa, Artificial Sequence
  Synthetic polymer.
QITLKESGPTLVKPTQTLTLTCTFSGYTFTSYWMYWVRQAPGKGLEWVSRIDPNSGSTKYNEKFKNRVTITADKSTSTAYMELSSLRSEDTAVYYCARDYRKGLYAMDYWGQGTTVTVSS

SEQ ID NO: 739 - protein, 120 aa, Artificial Sequence
  Synthetic polymer.
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSS

SEQ ID NO: 740 - protein, 107 aa, Artificial Sequence
  Synthetic polymer.
DIVMTQTPLSLPVTPGEPASISCKASQDVGTAVAWYLQKPGQSPQLLIYWASTRHTGIPARFSGSGSGTEFTLTISSLQSEDFAVYYCQQYNSYPLTFGQGTKVEIK

SEQ ID NO: 741 - protein, 107 aa, Artificial Sequence
  Synthetic polymer.
DIQMTQSPSSLSASVGDRVTITCKASQDVGTAVAWYLQKPGQSPQLLIYWASTRHTGVPSRFSGSGSGTDFTLTISSLQPEDFATYYCQQYNSYPLTFGQGTKVEIK

SEQ ID NO: 742 - protein, 107 aa, Artificial Sequence
  Synthetic polymer.
EIVLTQSPDFQSVTPKEKVTITCKASQDVGTAVAWYLQKPGQSPQLLIYWASTRHTGVPDRFSGSGSGTDFTLKISRVEAEDVGVYYCQQYNSYPLTFGQGTKVEIK

SEQ ID NO: 743 - protein, 107 aa, Artificial Sequence
  Synthetic polymer.
EIVLTQSPDFQSVTPKEKVTITCKASQDVGTAVAWYLQKPGQSPQLLIYWASTRHTGVPSRFSGSGSGTDFTFTISSLQPEDIATYYCQQYNSYPLTFGQGTKVEIK

SEQ ID NO: 744 - protein, 107 aa, Artificial Sequence
  Synthetic polymer.
EIVLTQSPATLSLSPGERATLSCKASQDVGTAVAWYLQKPGQSPQLLIYWASTRHTGIPPRFSGSGYGTDFTLTINNIESEDAAYYFCQQYNSYPLTFGQGTKVEIK

SEQ ID NO: 745 - protein, 107 aa, Artificial Sequence
  Synthetic polymer.
DVVMTQSPLSLPVTLGQPASISCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 746 - protein, 107 aa, Artificial Sequence
  Synthetic polymer.
DIQMTQSPSSLSASVGDRVTITCKASQDVGTAVAWYQQKPGQAPRLLIYWASTRHTGVPSRFSGSGSGTDFTFTISSLQPEDIATYYCQQYNSYPLTFGQGTKVEIK

SEQ ID NO: 747 - protein, 107 aa, Artificial Sequence
  Synthetic polymer.
AIQLTQSPSSLSASVGDRVTITCKASQDVGTAVAWYLQKPGQSPQLLIYWASTRHTGVPSRFSGSGSGTDFTFTISSLEAEDAATYYCQQYNSYPLTFGQGTKVEIK

SEQ ID NO: 748 - protein, 107 aa, Artificial Sequence
  Synthetic polymer.
EIVLTQSPDFQSVTPKEKVTITCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 749 - protein, 116 aa, Artificial Sequence
  Synthetic polymer.
EVKLVESGGGLVKPGGSLKLSCAASGFIFRSYGMSWVRQTPEKRLEWVASISSGGSTYYPDSVKGRFTISRDNARNILYLQMSSLRSEDTAMYDCARGYDSGFAYWGQGTLVTVSE

SEQ ID NO: 750 - protein, 116 aa, Artificial Sequence
  Synthetic polymer.
EVKLVESGGGLVKPGGSLKLSCAASGFTFRSYGMSWVRQTPEKRLEWVASISSGGTTYYPDSVKGRFIISRDNARNILYLQMSSLRSEDTAMYYCAKGYDSGFAYWGQGTLVIVSA

SEQ ID NO: 751 - protein, 116 aa, Artificial Sequence
  Synthetic polymer.
QVQLKQSGPGLVQPSQSLSITCTVSGFSLTTYGVHWVRQSPGKGLEWLGVIWRGVTTDYNAAFMSRLTITKDNSKSQVFFKMNSLQANDTAIYYCARLGFYAMDYWGQGTSVTVSS

SEQ ID NO: 752 - protein, 116 aa, Artificial Sequence
  Synthetic polymer.
QVQLKQSGPGLVQPSQSLSITCTVSGFSLTSYGVHWVRQSPGKGLEWLGVIWSGGVTDYNAAFISRLSISKDNSKSQVFFKMNSLQANDTAIYYCARLGFYAMDYWGQGTSVTVSS

SEQ ID NO: 753 - protein, 119 aa, Artificial Sequence
  Synthetic polymer.
EVKLFESGGGLVQPGGSLKLSCVASGFDFSTYWMHWVRQAPGQGLEWIGQINPDSTTINYAPSLKDRFIISRDNAKNTLFLQMSKVRSEDTALYYCAKPGDYGYDFDCWGQGTTLTVSS

SEQ ID NO: 754 - protein, 119 aa, Artificial Sequence
  Synthetic polymer.
EVQLQESGPSLVKPSQTLSLTCSVTGDSITSGYWNWIRKFPGNKLEYMGYISYSGSTYYNPSLKSRISITRDTSKNQYYLQLNSVTTEDTATYYCARSLLWFSTGFAYWGQGTLVTVSA

SEQ ID NO: 755 - protein, 116 aa, Artificial Sequence
  Synthetic polymer.
QVQLKQSGPGLVQPSQSLSITCTVSGFSLTSYGVHWVRQSPGKGLEWLGVIWSGGITDYNAAFKSRLSISKDNSKSQVFFKMNSLQANDTAIYFCARLGFYAMDYWGQGTSVTVSS

SEQ ID NO: 756 - protein, 116 aa, Artificial Sequence
  Synthetic polymer.
EVKLVESGGGLVKPGGSLKLSCAASGFTFRSYGMSWARQIPEKRLEWVASISSGGTTYYLGSVQGRFTISRDNARNILYLQMSSLRSEDTAMYYCARGYDAGFAYWGQGTLVSVSE

SEQ ID NO: 757 - protein, 117 aa, Artificial Sequence
  Synthetic polymer.
EVQLQESGPSLVKPSQTLSLTCSVTGDSITSGYWTWIRKFPGNKLEYMGYISYTGSTYYNPSLKSRISISRDTSKSQYYLQLNSVTTEDTATYYCARQRDWLGFAYWGQGTLVTVSA

SEQ ID NO: 758 - protein, 116 aa, Artificial Sequence
  Synthetic polymer.
EEKLVESGGGLVKPGGSLKLSCAASGFSFSSYGMSWVRQTPEKRLEWVASISSGGSIYYPDSVKGRFTISRDNARNILYLQMSSLRSEDTAMYYCARGYDAGFAFWGQGTLVTASA

SEQ ID NO: 759 - protein, 116 aa, Artificial Sequence
  Synthetic polymer.
QITLKESGPTLVKPTQTLTLTCTVSGFSLSTYGVHWIRQPPGKALEWLGVIWRGVTTDYNAAFMSRLTITKDNSKNQVVLTMNNMDPVDTATYYCARLGFYAMDYWGQGTLVTVSS

SEQ ID NO: 760 - protein, 116 aa, Artificial Sequence
  Synthetic polymer.
EVQLVESGGGLVKPGGSLRLSCAASGFIFRSYGMSWVRQAPGKGLEWVASISSGGSTYYPDSVKGRFTISRDNAKNSLYLQMNSLRAEDTAVYDCARGYDSGFAYWGQGTLVTVSS

SEQ ID NO: 761 - protein, 112 aa, Artificial Sequence
  Synthetic polymer.
DIVLTQSPASLAVSLGQRATISCRASQSVSTSSSSFMHWYQQKPGQPPKLLIKYASNLESGVPARFSGSGSGTDFTLNIHPVEEEDTATYYCQHSWEIPYTFGGGTKLEIKR

SEQ ID NO: 762 - protein, 111 aa, Artificial Sequence
  Synthetic polymer.
DIVLTQSPPSLAVSLGQRATISCRASQSVSTSSSSYMHWYQQKPGQPPKLLIKYASNLESGVPARFSGSGSGTDFTLNIHPVEEEDTATYYCQHSWEIPYTFGGGTKLEIK

SEQ ID NO: 763 - protein, 107 aa, Artificial Sequence
  Synthetic polymer.
SIVMTQTPKFLLVSAGDRVTITCKASQSVSNDVAWYQQKPGQSPKLLIYYAANRYTGVPDRFTGSGYGTDFTFTISIVQAEDLAVYFCQQDYTSPYTFGGGTKLEIK

SEQ ID NO: 764 - protein, 107 aa, Artificial Sequence
  Synthetic polymer.
SIVMTQTPKFLLVSAGDRVTITCKASQSVSNDVGWYQQKPGQSPKLLIYYASNRYSGVPDRFTGSGYGTDFTFTISTVQAEDLAVYFCQQDYTSPYTFGGGTKLEIK

SEQ ID NO: 765 - protein, 112 aa, Artificial Sequence
  Synthetic polymer.
DVLMTQTPLYLPVSLGDQASISCRSSQIIVHSNANTYLEWFLQKPGQSPKLLIYKVSNRFSGVPDRFSGSGSGTDFTLKISRVEAEDLGVYYCFQGSHVPYTFGGGTKLEIK

SEQ ID NO: 766 - protein, 108 aa, Artificial Sequence
  Synthetic polymer.
QIVLTQSPAIMSASPGEKVTLTCSASSSVSSSYLYWNQQKPGSSPKVWIYNTSNLASGVPARFSGSGSGTSYSLTISSMEAEDAASYFCHQWRSYPPTLGAGTKLELK

SEQ ID NO: 767 - protein, 106 aa, Artificial Sequence
  Synthetic polymer.
QIVLTQSPAIMSASPGEKVTMTCSANSSVSYMHWYQQKSGTSPKRWIYDTSKLASGVPARFSGSGSGTSYSLTISSMGAEDAATYYCQQWSSNPWTFGGGTKLEIK

SEQ ID NO: 768 - protein, 111 aa, Artificial Sequence
  Synthetic polymer.
DIVLTQSPASLAVSLGQRATISCRASQSVSTSSYSYMHWYQQKPGQPPKLLIKYASNLESGVPARFSGSGSGTDFTLNIHPVEEEDTATYYCQNSWEIPYTFGGGTKLEIK

SEQ ID NO: 769 - protein, 113 aa, Artificial Sequence
  Synthetic polymer.
DIVMTQTPSSLAVSLGEKVTMSCKSSQSLLYSSNQKNSLAWYQQKPGQSPKLLIYWASNRESGVPDRFTGSSSGTDFTLTISSVKAEDLAVYYCQQYYSYPLTFGAGTKLELK

SEQ ID NO: 770 - protein, 111 aa, Artificial Sequence
  Synthetic polymer.
DIVLTQSPASLAVSLGQRATISCRASQSVSTSSYSYVHWYQQKPGQPPKLLIKYASNLESGVPARFSGSGSGTDFTLNIHPVEEEDTATYYCQHSWEIPYTFGGGTKLEIK

SEQ ID NO: 771 - protein, 107 aa, Artificial Sequence
  Synthetic polymer.
DIQMTQSPSSLSASVGDRVTITCKASQSVSNDVAWYQQKPGKAPKLLIYYAANRYTGVPDRFSGSGYGTDFTFTISSLQPEDIATYFCQQDYTSPYTFGQGTKLEIK

SEQ ID NO: 772 - protein, 111 aa, Artificial Sequence
  Synthetic polymer.
DIVLTQSPASLAVSPGQRATITCRASQSVSTSSSSFMHWYQQKPGQPPKLLIKYASNLESGVPARFSGSGSGTDFTLTINPVEANDTANYYCQHSWEIPYTFGQGTKLEIK

SEQ ID NO: 773 - protein, 117 aa, Artificial Sequence
  Synthetic polymer.
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSS

SEQ ID NO: 774 - protein, 117 aa, Artificial Sequence
  Synthetic polymer.
EVQLVQSGAEVKKPGESLRISCKGSGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSS

SEQ ID NO: 775 - protein, 117 aa, Artificial Sequence
  Synthetic polymer.
QVQLVQSGAEVKKPGASVKVSCKASGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSS

SEQ ID NO: 776 - protein, 117 aa, Artificial Sequence
  Synthetic polymer.
EVQLVQSGAEVKKPGESLRISCKGSGYTFTTYWMHWVRQAPGQGLEWMGNIYPGTGGSNFDEKFKNRFTISRDNSKNTLYLQMNSLRAEDTAVYYCTRWTTGTGAYWGQGTTVTVSS

SEQ ID NO: 777 - protein, 113 aa, Artificial Sequence
  Synthetic polymer.
EIVLTQSPATLSLSPGERATLSCKSSQSLLDSGNQKNFLTWYQQKPGQAPRLLIYWASTRESGVPSRFSGSGSGTEFTLTISSLQPDDFATYYCQNDYSYPYTFGQGTKVEIK

SEQ ID NO: 778 - protein, 113 aa, Artificial Sequence
  Synthetic polymer.
DIQMTQSPSSLSASVGDRVTITCKSSQSLLDSGNQKNFLTWYQQKPGQAPRLLIYWASTRESGIPPRFSGSGYGTDFTLTINNIESEDAAYYFCQNDYSYPYTFGQGTKVEIK

SEQ ID NO: 779 - protein, 113 aa, Artificial Sequence
  Synthetic polymer.
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIK

SEQ ID NO: 780 - protein, 113 aa, Artificial Sequence
  Synthetic polymer.
DIVMTQTPLSLPVTPGEPASISCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 781 - protein, 113 aa, Artificial Sequence
  Synthetic polymer.
EIVLTQSPATLSLSPGERATLSCKSSQSLLDSGNQKNFLTWYQQKPGKAPKLLIYWASTRESGVPSRFSGSGSGTDFTFTISSLEAEDAATYYCQNDYSYPYTFGQGTKVEIK

SEQ ID NO: 782 - protein, 113 aa, Artificial Sequence
  Synthetic polymer.
EIVLTQSPDFQSVTPKEKVTITCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 783 - protein, 113 aa, Artificial Sequence
  Synthetic polymer.
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 784 - protein, 113 aa, Artificial Sequence
  Synthetic polymer.
DIQMTQSPSSLSASVGDRVTITCKSSQSLLDSGNQKNFLTWYLQKPGQSPQLLIYWASTRESGVPSRFSGSGSGTDFTFTISSLEAEDAATYYCQNDYSYPYTFGQGTKVEIK

SEQ ID NO: 785 - protein, 113 aa, Artificial Sequence
  Synthetic polymer.
DVVMTQSPLSLPVTLGQPASISCKSSQSLLDSGNQKNFLTWYQQKPGKAPKLLIYWASTRESGVPSRFSGSGSGTDFTFTISSLEAEDAATYYCQNDYSYPYTFGQGTKVEIK

SEQ ID NO: 786 - protein, 118 aa, Artificial Sequence
  Synthetic polymer.
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 787 - protein, 108 aa, Artificial Sequence
  Synthetic polymer.
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 788 - protein, 126 aa, Artificial Sequence
  Synthetic polymer.
EVQLVESGGGLVQPGGSLRLSCAASGFTLDYYAIGWFRQAPGKEREWASSISSSDGSTYYADSVKGRFTISRDNAKNTVFLQMNSLKPEDTAVYSCAASQAPITIATMMKPFYDYWGQGTQVTVSS

SEQ ID NO: 789 - protein, 123 aa, Artificial Sequence
  Synthetic polymer.
EVQLVESGGGLVQPGGSLRLSCAASGFTLDYYAKCWFRQAPGKEREWVSCISSSDGSTYYADSVKGRFTISRDNAKNTVYLQMNSLKPEDTAVYFCAARHGGPLTVEYFFDYWGQGTQVTVSS

SEQ ID NO: 790 - protein, 124 aa, Artificial Sequence
  Synthetic polymer.
EVQLVESGGGLVQPGGSLRLSCAASGFTFDYYAIGWFRQAPGKAREGVSCISGGDNSTYYADSVKGRFTISRDNAKNTVYLQMNSLKPEDTAVYYCATGGWKYCSGYDPEYIYWGQGTQVTVSS

SEQ ID NO: 791 - protein, 115 aa, Artificial Sequence
  Synthetic polymer.
EVQLVESGGGLVQAGGSLRLSCAASGSTFSQYDVGWYRQAPGKQRELVAFSSSGGRTIYPDSVKGRFTFSRDNTKNTVYLQMTSLKPEDTAVYYCKIDWYLNSYWGQGTQVTVSS

SEQ ID NO: 792 - protein, 114 aa, Artificial Sequence
  Synthetic polymer.
EVQLVESGGGLVQAGGSLRLSCAASGVDASNSAMGWYRQAPGKQREWVARITGGGLIAYTDSVKGRFTISRDNAKSTVYLQMNSLEPEDTAVYYCNTINSRDGWGQGTQVTVSS

SEQ ID NO: 793 - protein, 111 aa, Artificial Sequence
  Synthetic polymer.
EVQLVESGGGLVQAGGSLTISCAASGITFSDSIVSWYRRARGKQREWVAGISNGGTTKYAESVLGRFTISRDNAKNNVYLQMNGLNPEDTAVYLCKVRQYWGQGTQVTVSS

SEQ ID NO: 794 - protein, 130 aa, Artificial Sequence
  Synthetic polymer.
EVQLVESGGGLVQAGGSLRLSCAASESTVLINAMGWYRQAPGKQRELVASISSGGSTNYADSVKGRFTISRDNAKNTVYLQMNSLKPEDTAVYYCNADVYPQDYGLGYVEGKVYYGHDYWGTGTLVTVSS

SEQ ID NO: 795 - protein, 119 aa, Artificial Sequence
  Synthetic polymer.
EVQLVESGGGLVQAGGSLRLSCAASGSTFSNYVSNYAMGWGRQAPGTQRELVASISNGDTTNYADSVKGRFTISRDNAKNTVYLQMNSLKPEDTAVYYCFEHQVAGLTWGQGTQVTVSS

SEQ ID NO: 796 - protein, 118 aa, Artificial Sequence
  Synthetic polymer.
  misc_feature (27)..(27): Xaa can be any naturally occurring amino acid
  misc_feature (32)..(32): Xaa can be any naturally occurring amino acid
  misc_feature (75)..(75): Xaa can be any naturally occurring amino acid
EVQLVESGGGLVQAGGSLRLSCVASGXALKIXVMGWYRQAPGKQRELVAAITSGGRTNYSDSVKGRFTISGDNAXNTVYLQMNSLKSEDTAVYYCREWNSGYPPVDYWGQGTQVTVSS

SEQ ID NO: 797 - protein, 120 aa, Artificial Sequence
  Synthetic polymer.
EVQLVESGGGLVQAGGSLRLSCAASGRTFSSGTMGWFRRAPGKEREFVASIPWSGGRTYYADSVKDRFTISRDNAQNTVFLQMNSLKPEDTAVYYCAFKERSTGWDFASWGQGIQVTVSS

SEQ ID NO: 798 - protein, 127 aa, Artificial Sequence
  Synthetic polymer.
EVQLVESGGGLVQTGGSLRLSCAASGFTLDYYGIGWFRQAPGKEREGVSFISGSDGSTYYAESVKGRFTISRDKAKNTVYLQMNSLKPEDTAVYYCAADPWGPPSIATMTSYEYKHWGQGTQVTVSS

SEQ ID NO: 799 - protein, 113 aa, Artificial Sequence
  Synthetic polymer.
EVQLVESGGGLVQPGGSLRLSCAASGFTFSTYTMIWLRRAPGKGFEWVSTIDKDGNTNYVDSVKGRFAVSRDNTKNTLYLQMNSLKPEDTAMYYCTKHGSSARGQGTRVTVSS

SEQ ID NO: 800 - protein, 114 aa, Artificial Sequence
  Synthetic polymer.
EVQLVESGGGLVEPGGSLRLSCVASGFTFSSYDMSWVRQAPGKGLEWVSTINSGGGITYRGSVKGRFTISRDNAKNTLYLQMNSLKPEDTAVYYCENGGSSYRRGQGTQVTVSS

SEQ ID NO: 801 - protein, 114 aa, Artificial Sequence
  Synthetic polymer.
QVQLVQSGAELKKPGASVKMSCKASGYTFTGYTMHWVKQAPGQGLEWIGYINPRSGYTEYNQKFKDRTTLTADKSTSTAYMELSSLRSEDSAVYYCARPWFAYWGQGTLVTVSS

SEQ ID NO: 802 - protein, 114 aa, Artificial Sequence
  Synthetic polymer.
QVQLVQSGAEVKKPGASVKMSCKASGYTFTGYTMHWVKQAPGQGLEWIGYINPRSGYTEYNQKFKDRTTLTADKSTSTAYMELSSLRSEDTAVYYCARPWFAYWGQGTLVTVSS

SEQ ID NO: 803 - protein, 114 aa, Artificial Sequence
  Synthetic polymer.
QVQLVQSGAEVKKPGASVKMSCKASGYTFTGYTMHWVRQAPGQGLEWIGYINPRSGYTEYNQKFKDRTTLTADKSTSTAYMELSSLRSEDTAVYYCARPWFAYWGQGTLVTVSS

SEQ ID NO: 804 - protein, 114 aa, Artificial Sequence
  Synthetic polymer.
QVQLVQSGAEVKKPGASVKVSCKASGYTFTGYTMHWVRQAPGQGLEWIGYINPRSGYTEYNQKFKDRTTLTADKSTSTAYMELSSLRSEDTAVYYCARPWFAYWGQGTLVTVSS

SEQ ID NO: 805 - protein, 114 aa, Artificial Sequence
  Synthetic polymer.
QVQLVQSGAEVKKPGASVKVSCKASGYTFTGYTMHWVRQAPGQGLEWIGYINPRSGYTEYNQKFKDRTTITADKSTSTAYMELSSLRSEDTAVYYCARPWFAYWGQGTLVTVSS

SEQ ID NO: 806 - protein, 113 aa, Artificial Sequence
  Synthetic polymer.
DIVMTQSPASLTVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 807 - protein, 113 aa, Artificial Sequence
  Synthetic polymer.
DIVMTQSPASLSVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 808 - protein, 113 aa, Artificial Sequence
  Synthetic polymer.
DIVMTQSPAFLSVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 809 - protein, 113 aa, Artificial Sequence
  Synthetic polymer.
DIVMTQSPAFLSVTPGEKVTITCKSSQSLLNSGNQKNYLTWYQQKPGQPPKLLIYWASTRESGVPDRFSGSGSGTDFTLTISSLQAEDVAVYYCQNDYSYPLTFGQGTKLEIK

SEQ ID NO: 810 - protein, 5 aa, Artificial Sequence
  Synthetic polymer.
GGGGS

SEQ ID NO: 811 - protein, 10 aa, Artificial Sequence
  Synthetic polymer.
GGGGSGGGGS

SEQ ID NO: 812 - protein, 15 aa, Artificial Sequence
  Synthetic polymer.
GGGGSGGGGSGGGGS

SEQ ID NO: 813 - protein, 20 aa, Artificial Sequence
  Synthetic polymer.
GGGGSGGGGSGGGGSGGGGS

SEQ ID NO: 814 - protein, 25 aa, Artificial Sequence
  Synthetic polymer.
GGGGSGGGGSGGGGSGGGGSGGGGS

SEQ ID NO: 815 - protein, 30 aa, Artificial Sequence
  Synthetic polymer.
GGGGSGGGGSGGGGSGGGGSGGGGSGGGGS

SEQ ID NO: 816 - protein, 35 aa, Artificial Sequence
  Synthetic polymer.
GGGGSGGGGSGGGGSGGGGSGGGGSGGGGSGGGGS

SEQ ID NO: 817 - protein, 40 aa, Artificial Sequence
  Synthetic polymer.
GGGGSGGGGSGGGGSGGGGSGGGGSGGGGSGGGGSGGGGS

SEQ ID NO: 818 - protein, 16 aa, Artificial Sequence
  Synthetic polymer.
GGSGGSGGGGSGGGGS

SEQ ID NO: 819 - protein, 8 aa, Artificial Sequence
  Synthetic polymer.
GGGGGGGG

SEQ ID NO: 820 - protein, 6 aa, Artificial Sequence
  Synthetic polymer.
GGGGGG

SEQ ID NO: 821 - protein, 5 aa, Artificial Sequence
  Synthetic polymer.
EAAAK

SEQ ID NO: 822 - protein, 10 aa, Artificial Sequence
  Synthetic polymer.
EAAAKEAAAK

SEQ ID NO: 823 - protein, 15 aa, Artificial Sequence
  Synthetic polymer.
EAAAKEAAAKEAAAK

SEQ ID NO: 824 - protein, 12 aa, Artificial Sequence
  Synthetic polymer.
AEAAAKEAAAKA

SEQ ID NO: 825 - protein, 17 aa, Artificial Sequence
  Synthetic polymer.
AEAAAKEAAAKEAAAKA

SEQ ID NO: 826 - protein, 22 aa, Artificial Sequence
  Synthetic polymer.
AEAAAKEAAAKEAAAKEAAAKA

SEQ ID NO: 827 - protein, 27 aa, Artificial Sequence
  Synthetic polymer.
AEAAAKEAAAKEAAAKEAAAKEAAAKA

SEQ ID NO: 828 - protein, 46 aa, Artificial Sequence
  Synthetic polymer.
AEAAAKEAAAKEAAAKEAAAKALEAEAAAKEAAAKEAAAKEAAAKA

SEQ ID NO: 829 - protein, 5 aa, Artificial Sequence
  Synthetic polymer.
PAPAP

SEQ ID NO: 830 - protein, 18 aa, Artificial Sequence
  Synthetic polymer.
KESGSVSSEQLAQFRSLD

SEQ ID NO: 831 - protein, 14 aa, Artificial Sequence
  Synthetic polymer.
EGKSSGSGSESKST

SEQ ID NO: 832 - protein, 12 aa, Artificial Sequence
  Synthetic polymer.
GSAGSAAGSGEF

SEQ ID NO: 833 - protein, 5 aa, Artificial Sequence
  Synthetic polymer.
GGGSE

SEQ ID NO: 834 - protein, 5 aa, Artificial Sequence
  Synthetic polymer.
GSESG

SEQ ID NO: 835 - protein, 5 aa, Artificial Sequence
  Synthetic polymer.
GSEGS

SEQ ID NO: 836 - protein, 35 aa, Artificial Sequence
  Synthetic Sequence
GEGGSGEGSSGEGSSSEGGGSEGGGSEGGGSEGGS

SEQ ID NO: 837 - protein, 117 aa, Artificial Sequence
  Synthetic Sequence
QVQLQESGGGLVQPGGSLRLSCAVSGTMLSRNAMGWYRQAPGKPRQWVAGITSDGLGNYVGFAKGRFTISRDNAKNTVYLQMNTLKPDDTAVYHCNFWPPPSGRPIWGQGTQVTVSS

SEQ ID NO: 838 - protein, 117 aa, Artificial Sequence
  Synthetic
QVQLQESGGGLVQPGGSLRLSCAVSGTMLSRNAMGWYRQAPGKQRQWVAGITSDGLGNYVDFVKGRFTISRDNARNTVYLQMNTLKPDDTAVYYCNFWPPPSDRPIWGQGTQVTVSS

SEQ ID NO: 839 - protein, 116 aa, Artificial Sequence
  Synthetic
QVQLQESGGGLVQAGGSLRLSCAVSGSTARLDAMGWYRQAPGKQREWVAGIDSADITDYARFVKGRFTISRDNAKNTVYLQMNSLKPEDTAVYYCNKWPPSVPPNWGHGTQVTVSS

SEQ ID NO: 840 - protein, 116 aa, Artificial Sequence
  Synthetic
QVQLQESGGGLVQAGGSLRLSCAVSGSTARLDAMGWYRQAPGKQREWVAGIDSADITDYARFVKGRFTISRDNAKNTVYLQMNSLKPEDTAVYYCNKWPPSVPPNWGQGTQVTVSS

SEQ ID NO: 841 - protein, 124 aa, Artificial Sequence
  Synthetic
QVQLQESGGGLVQAGGSLRLSCVHSGGIFTIGPLGWYRQAPGSQRELVATVTNGGGTYYADSVKGRFTISRDNAKNTVYLQMNSLKPEDTAVYYCNAAVVTAKGMGAIQSRGYWGQGTQVTVSS

SEQ ID NO: 842 - protein, 124 aa, Artificial Sequence
  Synthetic
QVQLQESGGGLVQAGGSLRLSCAHSGGIFTIGPLGWYRQAPGSQRELVATVTNGGGTYYADSVKGRFTISRDNAKNTVYLQMNSLKPEDTAVYYCNAAVVTAKGMGAIQSRGYWGQGTQVTVSS

SEQ ID NO: 843 - protein, 116 aa, Artificial Sequence
  Synthetic
QVQLQESGGGLVQAGGSLRLSCAASGSTFSINAMMWYRQAPGKQRELVASIGSGGNTYYADSVKGRFTISRDNGKSTLYLQMNSLKPEDTAVYYCKMYRPGTYDYWGQGTQVTVSS

SEQ ID NO: 844 - protein, 116 aa, Artificial Sequence
  Synthetic
QVQLQESGGGWVQPGGSLRLSCAASGSTFSINAMMWYRQAPGKQRELVASIGSGGNTYYADSVKGRFTISRDNGKSTLYLQMNSLKPEDTAVYYCKMYRPGTYDYWGQGTQVTVSS

SEQ ID NO: 845 - protein, 122 aa, Artificial Sequence
  Synthetic
QVQLQESGGGLVQAGGSLSVSCAASGSIFSMGWFRQAPGKQRELVAAVTSGGVTNYADSVKGRFTISRDNAKNTVYLQMKSLKPEDTAVYYCAADSSRGKIYFSNYRSWNYWGQGTQVTVSS

SEQ ID NO: 846 - protein, 115 aa, Artificial Sequence
  Synthetic
QVQLQESGGGLVQAGESLRLSCAVSATISSMNSMAWYRQAPGKQREWVAGLETGGRANYVDSVKGRFTISRDNARNTVLLQMNSLKPEDTAVYYCNRWPPLRSSWGQGTQVTVSS

SEQ ID NO: 847 - protein, 116 aa, Artificial Sequence
  Synthetic
QVQLQESGGGLVQPGESLRLSCAASGSISSRNAMGWYRQAPGKEREWVAGITSDGITNYADSVKGRFTISRDNAKNTVGLQMNSLKPDDTAVYYCNFWPPLYGRPWGQGTQVTVSS

SEQ ID NO: 848 - protein, 116 aa, Artificial Sequence
  Synthetic
QVQLQESGGGLVQPGGSLRLSCAASGFIFRSTSMGWYRQAPGKQREFVAGIIGSHSTNYADSVKGRFTISRDNAQNAVYLHMNTLKPEDTAVYYCNLYPPASSGRWGKGTQVTVSS

SEQ ID NO: 849 - protein, 116 aa, Artificial Sequence
  Synthetic
QVQLQESGGGLVQAGGSLRLSCAASLKISSINAMAWYRQAAGKQRELVAGIATDGRTNYAHSVKGRFTISRDNAKNTVYLQMNSLKPEDTAVYYCNQWPPRALDAWGQGTQVTVSS

SEQ ID NO: 850 - protein, 117 aa, Artificial Sequence
  Synthetic
QVQLQESGGGLVQPGGSLRLSCAASGVTFGIGAMGWYRQTPENERELVAAISSGGSTNYAASVKGRFTISRDNAPNTVYLQMNSLKPEDTAIYYCNVRRGLAWYPGWGQGTQVTVSS

SEQ ID NO: 851 - protein, 10 aa, Artificial Sequence
  Synthetic
GSTFSVNAVG

SEQ ID NO: 852 - protein, 10 aa, Artificial Sequence
  Synthetic
GSTFTINAMA

SEQ ID NO: 853 - protein, 10 aa, Artificial Sequence
  Synthetic
GSTFTINAMG

SEQ ID NO: 854 - protein, 10 aa, Artificial Sequence
  Synthetic
GSTSSINAMA

SEQ ID NO: 855 - protein, 10 aa, Artificial Sequence
  Synthetic
GSTSSMNAMA

SEQ ID NO: 856 - protein, 10 aa, Artificial Sequence
  Synthetic
GTMLSRNAMG

SEQ ID NO: 857 - protein, 10 aa, Artificial Sequence
  Synthetic
GVELSRSAMA

SEQ ID NO: 858 - protein, 10 aa, Artificial Sequence
  Synthetic
GVTFGIGAMG

SEQ ID NO: 859 - protein, 10 aa, Artificial Sequence
  Synthetic
LKISSINAMA

SEQ ID NO: 860 - protein, 11 aa, Artificial Sequence
  Synthetic
SGSTFSINAMA

SEQ ID NO: 861 - protein, 10 aa, Artificial Sequence
  Synthetic
VNIVNLNSVG

SEQ ID NO: 862 - protein, 16 aa, Artificial Sequence
  Synthetic
GITSGGSTNYADSVKG

SEQ ID NO: 863 - protein, 15 aa, Artificial Sequence
  Synthetic
GITSGVTHYPDSVKG

SEQ ID NO: 864 - protein, 16 aa, Artificial Sequence
  Synthetic
GITSSGVTKYPDSVKG

SEQ ID NO: 865 - protein, 16 aa, Artificial Sequence
  Synthetic
GITSSGVTNYPDSVKG

SEQ ID NO: 866 - protein, 16 aa, Artificial Sequence
  Synthetic
GITSSGVTQYPDSVKG

SEQ ID NO: 867 - protein, 16 aa, Artificial Sequence
  Synthetic
GITTDGITKYPDSLKG

SEQ ID NO: 868 - protein, 16 aa, Artificial Sequence
  Synthetic
GLETGGRANYVDSVKG

SEQ ID NO: 869 - protein, 16 aa, Artificial Sequence
  Synthetic
SIGSGGNTYYADSVKG

SEQ ID NO: 870 - protein, 16 aa, Artificial Sequence
  Synthetic
SIISDGRTNYADSVKG

SEQ ID NO: 871 - protein, 16 aa, Artificial Sequence
  Synthetic
SITSAGSTNYAESVKG

SEQ ID NO: 872 - protein, 16 aa, Artificial Sequence
  Synthetic
SITSDGRTNYADSVKG

SEQ ID NO: 873 - protein, 16 aa, Artificial Sequence
  Synthetic
SITSGGRTNYADSVKG

SEQ ID NO: 874 - protein, 16 aa, Artificial Sequence
  Synthetic
SITSGGRTNYSDSVKG

SEQ ID NO: 875 - protein, 16 aa, Artificial Sequence
  Synthetic
TFTRGGDINYADSVKG

SEQ ID NO: 876 - protein, 16 aa, Artificial Sequence
  Synthetic
TVTNGGGTYYADSVKG

SEQ ID NO: 877 - protein, 8 aa, Artificial Sequence
  Synthetic
RWPPLRSS

SEQ ID NO: 878 - protein, 9 aa, Artificial Sequence
  Synthetic
TPPRIGRGY

SEQ ID NO: 879 - protein, 10 aa, Artificial Sequence
  Synthetic
VRRGLAWYPG

SEQ ID NO: 880 - protein, 121 aa, Artificial Sequence
  Synthetic
QVQLQQSGPGLVKPSQTLSLTCAISGDSVSSNSVTWNWIRQSPSRGLEWLGRTYYRSKWYNDYAVSVKGRITINPDTSKNQFYLQLKSVTPEDAAVYYCARDSSILYGDYWGQGTLVTVSS

SEQ ID NO: 881 - protein, 115 aa, Artificial Sequence
  Synthetic
QAVLTQPSSLSASPGASASLTCTLPSGINVGTYRIFWFQQKPGSPPQYLLSYKSDSDNHQGSGVPSRFSGSKDASANAGILLISGLQSEDEADYYCMIWHSSAWVFGGGTKLTVL

SEQ ID NO: 882 - protein, 12 aa, Artificial Sequence
  Synthetic (VH chain of NI-206.82C2)
GDSVSSNSVTWN

SEQ ID NO: 883 - protein, 14 aa, Artificial Sequence
  Synthetic (VH chain of NI-206.82C2)
CDRRTYYRSKWYND

SEQ ID NO: 884 - protein, 9 aa, Artificial Sequence
  Synthetic (VH chain of NI-206.82C2)
DSSILYGDY

SEQ ID NO: 885 - protein, 121 aa, Artificial Sequence; identical to SEQ ID NO: 719
  Synthetic polymer.

SEQ ID NO: 886 - protein, 108 aa, Artificial Sequence; identical to SEQ ID NO: 730
  Synthetic polymer.

SEQ ID NO: 887 - protein, 448 aa, Artificial Sequence
  Synthetic polymer.
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 888 - protein, 214 aa, Artificial Sequence
  Synthetic polymer.
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 889 - protein, 450 aa, Artificial Sequence
  Synthetic polymer.
EVQLLESGGGIYPSGGITFYLGTVTTVDYWDYFPEPVTVSYICNVNHKPSKDTLMISRTPSTYRVVSVLTVYTLPPSRDELDSDGSFFLYLVQPGGSLRLADTVKGRFTIGQGTLVTVSSWNSGALTSGVNTKVDKKVEPEVTCVVVDVSVLHQDWLNGKLTKNQVSLTCSKLTVDKSRWSCAASGFTFSSRDNSKNTLYASTKGPSVFPHTFPAVLQSSKSCDKTHTCPHEDPEVKFNWEYKCKVSNKALVKGFYPSDIQQGNVFSCSVSYIMMWVRQALQMNSLRAEDLAPSSKSTSGGLYSLSSVVTPCPAPELLGGYVDGVEVHNALPAPIEKTISAVEWESNGQPMHEALHNHYTPGKGLEWVSSTAVYYCARIKGTAALGCLVKVPSSSLGTQTPSVFLFPPKPKTKPREEQYNKAKGQPREPQENNYKTTPPVQKSLSLSPGK

SEQ ID NO: 890 - protein, 216 aa, Artificial Sequence
  Synthetic polymer.
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 891 - protein, 123 aa, Artificial Sequence
  Synthetic polymer.
QVQLVQSGAEVKKPGSSVKVSCKTSGDTESTYAISWVRQAPGQGLEWMGGIIPIEGKAHYAQKFQGRVTITADESTSTAYMELSSLRSEDTAVYFCARKFHEVSGSPFGMDVWGQGTTVTVSS

SEQ ID NO: 892 - protein, 106 aa, Artificial Sequence
  Synthetic polymer.
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 893 - protein, 117 aa, Artificial Sequence
  Synthetic polymer.
QVQLVQSGAEVKKPGASVKVSCKASGYTFTDYGFSWVRQAPGQGLEWMGWITAYNGNTNYAQKLQGRVTMTTDTSTSTVYMELRSLRSDDTAVYYCARDYFYGMDVWGQGTTVTVSS

SEQ ID NO: 894 - protein, 107 aa, Artificial Sequence
  Synthetic polymer.
EIVLTQSPATLSLSPGERATLSCRASQSVSSYLVWYQQKPGQAPRLLIYDASNRATGIPARFSGSGSGTDFTLTISSLEPEDFAVYYCQQRSNWPRTFGQGTKVEIK

SEQ ID NO: 895 - protein, 118 aa, Artificial Sequence
  Synthetic polymer.
QVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 896 - protein, 107 aa, Artificial Sequence
  Synthetic polymer.
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 897 - protein, 120 aa, Artificial Sequence
  Synthetic polymer.
QVQLVQSGAEVKKPGSSVKVSCKVSGGIFSTYAINWVRQAPGQGLEWMGGIIPIFGTANHAQKFQGRVTITADESTSTAYMELSSLRSEDTAVYYCARDQGIAAALFDYWGQGTLVTVSS

SEQ ID NO: 898 - protein, 108 aa, Artificial Sequence
  Synthetic polymer.
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 899 - protein, 113 aa, Artificial Sequence
  Synthetic polymer.
EVQLVESGGGLVQPGRSLRLSCAVSGETFDDYVVHWVRQAPGKGLEWVSGISGNSGNIGYADSVKGRFTISRDNAKNSLYLQMNSLRAEDTALYYCAVPFDYWGQGTLVTVSS

SEQ ID NO: 900 - protein, 107 aa, Artificial Sequence; identical to SEQ ID NO: 896
  Synthetic polymer.

SEQ ID NO: 901 - protein, 123 aa, Artificial Sequence
  Synthetic polymer.
QVQLVQSGAEVKKPGSSVKVSCKTSGDTFSSYAISWVRQAPGQGLEWMGGIIPIFGRAHYAQKFQGRVTITADESTSTAYMELSSLRSEDTAVYFCARKFHEVSGSPFGMDVWGQGTTVTVSS

SEQ ID NO: 902 - protein, 106 aa, Artificial Sequence; identical to SEQ ID NO: 892
  Synthetic polymer.

SEQ ID NO: 903 - protein, 123 aa, Artificial Sequence
  Synthetic polymer.
QVQLVQSGAEVKKPGSSVKVSCKTSGGTFSSYAISWVRQAPGQGLEWMGGIIPIFGKAHYAQKFQGRVTITADESTTTAYMELSSLRSEDTAVYYCARKYDYVSGSPFGMDVWGQGTTVTVSS

SEQ ID NO: 904 - protein, 106 aa, Artificial Sequence; identical to SEQ ID NO: 892
  Synthetic polymer.

SEQ ID NO: 905 - protein, 121 aa, Artificial Sequence
  Synthetic polymer.
QVQLVQSGAEVKKPGSSVKVSCKASGGTFSSYAINWVRQAPGQGLEWMGGIIPIFGSANYAQKFQDRVTITADESTSAAYMELSSLRSEDTAVYYCARDSSGWSRYYMDVWGQGTTVTVSS

SEQ ID NO: 906 - protein, 106 aa, Artificial Sequence
  Synthetic polymer.
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFGGGTKVEIK

SEQ ID NO: 907 - protein, 123 aa, Artificial Sequence
  Synthetic polymer.
QVQLVQSGAEVKEPGSSVKVSCKASGGTFNSYAISWVRQAPGQGLEWMGGIIPLFGIAHYAQKFQGRVTITADESTNTAYMDLSSLRSEDTAVYYCARKYSYVSGSPFGMDVWGQGTTVTVSS

SEQ ID NO: 908 - protein, 106 aa, Artificial Sequence
  Synthetic polymer.
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTRLEIK

SEQ ID NO: 909 - protein, 121 aa, Artificial Sequence
  Synthetic polymer.
EVQLVESGGGLVQPGRSLRLSCAASGITFDDYGMHWVRQAPGKGLEWVSGISWNRGRIEYADSVKGRFTISRDNAKNSLYLQMNSLRAEDTALYYCAKGRFRYFDWFLDYWGQGTLVTVSS

SEQ ID NO: 910 - protein, 107 aa, Artificial Sequence
  Synthetic polymer.
AIQLTQSPSSLSASVGDRVTITCRASQGISSALAWYQQKPGKAPKLLIYDASSLESGVPSRFSGSGSGTDFTLTISSLQPEDFATYYCQQFNSYPFTFGPGTKVDIK

SEQ ID NO: 911 - protein, 118 aa, Artificial Sequence
  Synthetic polymer.
EVKLQESGPSLVKPSQTLSLTCSVTGYSITSDYWNWIRKFPGNKLEYVGYISYTGSTYYNPSLKSRISITRDTSKNQYYLQLNSVTSEDTATYYCARYGGWLSPFDYWGQGTTLTVSS

SEQ ID NO: 912 - protein, 107 aa, Artificial Sequence
  Synthetic polymer.
DIVMTQSHKLMSTSVGDRVSITCKASQDVGTAVAWYQQKPGQSPKLLIYWASTRHTGVPDRFTGSGSGTDFTLTISNVQSEDLADYFCQQDSSYPLTFGAGTKVELK

SEQ ID NO: 913 - protein, 120 aa, Artificial Sequence
  Synthetic polymer.
EVQLQESGPGLVAPSQSLSITCTVSGFSLTTYSINWIRQPPGKGLEWLGVMWAGGGTNSNSVLKSRLIISKDNSKSQVFLKMNSLQTDDTARYYCARYYGNSPYYAIDYWGQGTSVTVSS

SEQ ID NO: 914 - protein, 107 aa, Artificial Sequence
  Synthetic polymer.
DIVTTQSHKLMSTSVGDRVSITCKASQDVGTAVAWYQQKPGQSPKLLIYWASTRHTGVPDRFTGSGSGTDFTLTISNVQSEDLADYFCQQDSSYPLTFGAGTKVELK

SEQ ID NO: 915 - protein, 14 aa, Artificial Sequence
  Synthetic (VL chain of NI-206.82C2)
TLPSGINVGTYRIF

SEQ ID NO: 916 - protein, 7 aa, Artificial Sequence
  Synthetic (VL chain of NI-206.82C2)
KSDSDNH

SEQ ID NO: 917 - protein, 9 aa, Artificial Sequence
  Synthetic (VL chain of NI-206.82C2)
MIWHSSAWV

SEQ ID NO: 918 - protein, 122 aa, Artificial Sequence
  Synthetic
QVQLVQSGAEVKKPGASVKVSCKTSGYTFTDYYIHWVRQAPGQGLEWMGWINPNRGGTNYAQKFQGRVTMTRDTSIATAYMELSRLRSDDTAVYYCATASLKIAAVGTFDCWGQGTLVTVSS

SEQ ID NO: 919 - protein, 107 aa, Artificial Sequence
  Synthetic
SYELTQPPSVSVSPGQTARITCSGDALSKQYAFWFQQKPGQAPILVIYQDTKRPSGIPGRFSGSSSGTTVTLTISGAQADDEADYYCQSADSSGTYVFGTGTKVTVL

SEQ ID NO: 920 - protein, 10 aa, Artificial Sequence
  Synthetic
GYTFTDYYIH

SEQ ID NO: 921 - protein, 10 aa, Artificial Sequence
  Synthetic
WINPNRGGTN

SEQ ID NO: 922 - protein, 13 aa, Artificial Sequence
  Synthetic
ASLKIAAVGTFDC

SEQ ID NO: 923 - protein, 11 aa, Artificial Sequence
  Synthetic
SGDALSKQYAF

SEQ ID NO: 924 - protein, 7 aa, Artificial Sequence
  Synthetic
QDTKRPS

SEQ ID NO: 925 - protein, 10 aa, Artificial Sequence
  Synthetic
QSADSSGTYV

SEQ ID NO: 926 - protein, 116 aa, Artificial Sequence
  Synthetic
EVQLVETGGGVVQPGRSLRLSCAASGFSFSTHGMYWVRQPPGKGLEWVAVISYDGSDKKYADSVKGRFTISRDNSKNTVYLEMSSVRAEDTALYYCFCRRDAFDLWGQGTMVTVSS

SEQ ID NO: 927 - protein, 108 aa, Artificial Sequence
  Synthetic
SYVLTQPPSVSVSPGQTARITCSGDALPKKYAYWYQQKSGQAPVLVIYEDTKRPSGIPERFSGSSSGTMATLTISGAQVEDEADYYCYSTDSSGNYWVFGGGTEVTVL

SEQ ID NO: 928 - protein, 10 aa, Artificial Sequence
  Synthetic
GFSFSTHGMY

SEQ ID NO: 929 - protein, 10 aa, Artificial Sequence
  Synthetic
VISYDGSDKK

SEQ ID NO: 930 - protein, 7 aa, Artificial Sequence
  Synthetic
RRDAFDL

SEQ ID NO: 931 - protein, 11 aa, Artificial Sequence
  Synthetic
SGDALPKKYAY

SEQ ID NO: 932 - protein, 7 aa, Artificial Sequence
  Synthetic
EDTKRPS

SEQ ID NO: 933 - protein, 11 aa, Artificial Sequence
  YSTDSSGNYWV
YSTDSSGNYWV

SEQ ID NO: 934 - protein, 124 aa, Artificial Sequence
  Synthetic
EVQLVESGGGLVEPGGSLRLSCAASGFTFSDAWMNWVRQAPGKGLEWVGRIKTKSDGGTTDYAAPVRGRFSISRDDSKNTLFLEMNSLKTEDTAIYYCFITVIVVSSESPLDHWGQGTLVTVSS

SEQ ID NO: 935 - protein, 108 aa, Artificial Sequence
  Synthetic
SYELTQPPSVSVSPGQTARITCSGDELPKQYAYWYQQKPGQAPVLVIYKDRQRPSGIPERFSGSSSGTTVTLTISGVQAEDEADYYCQSAYSINTYVIFGGGTKLTVL

SEQ ID NO: 936 - protein, 10 aa, Artificial Sequence
  Synthetic
GFTFSDAWMN

SEQ ID NO: 937 - protein, 12 aa, Artificial Sequence
  Synthetic
RIKTKSDGGTTD

SEQ ID NO: 938 - protein, 13 aa, Artificial Sequence
  Synthetic
TVIVVSSESPLDH

SEQ ID NO: 939 - protein, 11 aa, Artificial Sequence
  Synthetic
SGDELPKQYAY

SEQ ID NO: 940 - protein, 7 aa, Artificial Sequence
  Synthetic
KDRQRPS

SEQ ID NO: 941 - protein, 11 aa, Artificial Sequence
  Synthetic
QSAYSINTYVI

SEQ ID NO: 942 - protein, 125 aa, Artificial Sequence
  Synthetic
EVQLVESGGGLVKPGGSLRLSCAASGFTFSDYYMSWIRQAPGKGLEWISYISSGSSYTNYADSVKGRFTISRDNAKKSVYLEVNGLTVEDTAVYYCARVRYGDREMATIGGFDFWGQGTLVTVSS

SEQ ID NO: 943 - protein, 108 aa, Artificial Sequence
  Synthetic
SYELTQPPSVSVSPGQTARITCSGDALPKQYAYWYQQSPGQAPVLVIYKDSERPSGIPERFSGSSSGTTVTLTISGVQAEDEADYYCQSADSGGTSRIFGGGTKLTVL

SEQ ID NO: 944 - protein, 10 aa, Artificial Sequence
  Synthetic
GFTFSDYYMS

SEQ ID NO: 945 - protein, 10 aa, Artificial Sequence
  Synthetic
YISSGSSYTN

SEQ ID NO: 946 - protein, 16 aa, Artificial Sequence
  Synthetic
VRYGDREMATIGGFDF

SEQ ID NO: 947 - protein, 11 aa, Artificial Sequence
  Synthetic
SGDALPKQYAY

SEQ ID NO: 948 - protein, 7 aa, Artificial Sequence
  Synthetic
KDSERPS

SEQ ID NO: 949 - protein, 11 aa, Artificial Sequence
  Synthetic
QSADSGGTSRI

SEQ ID NO: 950 - protein, 124 aa, Artificial Sequence
  Synthetic
QVQLQESGPGLVRSTETLSLTCLVSGDSINSHYWSWLRQSPGRGLEWIGYIYYTGPTNYNPSLKSRVSISLGTSKDQFSLKLSSVTAADTARYYCARNKVFWRGSDFYYYMDVWGKGTTVTVSS

SEQ ID NO: 951 - protein, 110 aa, Artificial Sequence
  Synthetic
EIVLTQSPGTLSLSLGERATLSCRASQSLANNYLAWYQQKPGQAPRLLMYDASTRATGIPDRFSGSGSGTDFTLTISRLEPEDFAVYYCQQFVTSHHMYIFGQGTKVEIK

SEQ ID NO: 952 - protein, 10 aa, Artificial Sequence
  Synthetic
GDSINSHYWS

SEQ ID NO: 953 - protein, 9 aa, Artificial Sequence
  Synthetic
YIYYTGPTN

SEQ ID NO: 954 - protein, 16 aa, Artificial Sequence
  Synthetic
NKVFWRGSDFYYYMDV

SEQ ID NO: 955 - protein, 12 aa, Artificial Sequence
  Synthetic
RASQSLANNYLA

SEQ ID NO: 956 - protein, 7 aa, Artificial Sequence
  Synthetic
DASTRAT

SEQ ID NO: 957 - protein, 11 aa, Artificial Sequence
  Synthetic
QQFVTSHHMYI

SEQ ID NO: 958 - protein, 124 aa, Artificial Sequence
  Synthetic
QVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSS

SEQ ID NO: 959 - protein, 113 aa, Artificial Sequence
  Synthetic
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIK

SEQ ID NO: 960 - protein, 10 aa, Artificial Sequence
  Synthetic
RYTFTEYTIH

SEQ ID NO: 961 - protein, 10 aa, Artificial Sequence
  Synthetic
GINPNNGIPN

SEQ ID NO: 962 - protein, 15 aa, Artificial Sequence
  Synthetic
RRIAYGYDEGHAMDY

SEQ ID NO: 963 - protein, 17 aa, Artificial Sequence
  Synthetic
KSSQSLLYSRNQKNYLA

SEQ ID NO: 964 - protein, 7 aa, Artificial Sequence
  Synthetic
WASTRES

SEQ ID NO: 965 - protein, 9 aa, Artificial Sequence
  Synthetic
QQYFSYPLT

SEQ ID NO: 966 - protein, 117 aa, Artificial Sequence
  Synthetic
QVQLQQSGAELARPGASVNLSCKASGYTFTNNGINWLKQRTGQGLEWIGEIYPRSTNTLYNEKFKGKATLTADRSSNTAYMELRSLTSEDSAVYFCARTLTAPFAFWGQGTLVTVSA

SEQ ID NO: 967 - protein, 107 aa, Artificial Sequence
  Synthetic
QIVLTQSPAIMSASPGEKVTMTCSASSGVNFMHWYQQKSGTSPKRWIFDTSKLASGVPARFSGSGSGTSYSLTISSMEAEDAATYYCQQWSFNPPTFGGGTKLEIKR

SEQ ID NO: 968 - protein, 10 aa, Artificial Sequence
  Synthetic
GYTFTNNGIN

SEQ ID NO: 969 - protein, 10 aa, Artificial Sequence
  Synthetic
EIYPRSTNTL

SEQ ID NO: 970 - protein, 8 aa, Artificial Sequence
  Synthetic
TLTAPFAF

SEQ ID NO: 971 - protein, 10 aa, Artificial Sequence
  Synthetic
SASSGVNFMH

SEQ ID NO: 972 - protein, 7 aa, Artificial Sequence
  Synthetic
DTSKLAS

SEQ ID NO: 973 - protein, 9 aa, Artificial Sequence
  Synthetic
QQWSFNPPT

SEQ ID NO: 974 - protein, 117 aa, Artificial Sequence
  Synthetic
QVQLVQSGAEVKKPGASVKVSCKASGYTFTNNGINWLRQAPGQGLEWMGEIYPRSTNTLYAQKFQGRVTITADRSSNTAYMELSSLRSEDTAVYFCARTLTAPFAFWGQGTLVTVSS

SEQ ID NO: 975 - protein, 107 aa, Artificial Sequence
  Synthetic
QIVLTQSPATLSLSPGERATLSCSASSGVNFMHWYQQKPGQAPRRLIFDTSKLASGIPARFSGSGSGTDYTLTISSLEPEDFAVYYCQQWSFNPPTFGQGTKVEIKR

SEQ ID NO: 976 - protein, 10 aa, Artificial Sequence
  Synthetic
GYTFTNNGIN

SEQ ID NO: 977 - protein, 10 aa, Artificial Sequence
  Synthetic
EIYPRSTNTL

SEQ ID NO: 978 - protein, 8 aa, Artificial Sequence
  Synthetic
TLTAPFAF

SEQ ID NO: 979 - protein, 10 aa, Artificial Sequence
  Synthetic
SASSGVNFMH

SEQ ID NO: 980 - protein, 7 aa, Artificial Sequence
  Synthetic
DTSKLAS

SEQ ID NO: 981 - protein, 9 aa, Artificial Sequence
  Synthetic
QQWSFNPPT

SEQ ID NO: 982 - protein, 117 aa, Artificial Sequence; identical to SEQ ID NO: 974
  Synthetic

SEQ ID NO: 983 - protein, 107 aa, Artificial Sequence
  Synthetic
QIVLTQSPATLSLSPGERATLSCSASSGVNFMHWYQQKPGQAPKRLIFDTSKLASGVPARFSGSGSGTDYTLTISSLEPEDFAVYYCQQWSFNPPTFGQGTKVEIKR

SEQ ID NO: 984 - protein, 10 aa, Artificial Sequence
  Synthetic
GYTFTNNGIN

SEQ ID NO: 985 - protein, 10 aa, Artificial Sequence
  Synthetic
EIYPRSTNTL

SEQ ID NO: 986 - protein, 8 aa, Artificial Sequence
  Synthetic
TLTAPFAF

SEQ ID NO: 987 - protein, 10 aa, Artificial Sequence
  Synthetic
SASSGVNFMH

SEQ ID NO: 988 - protein, 7 aa, Artificial Sequence
  Synthetic
DTSKLAS

SEQ ID NO: 989 - protein, 9 aa, Artificial Sequence
  Synthetic
QQWSFNPPT

SEQ ID NO: 990 - protein, 117 aa, Artificial Sequence
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGWLGNFDYWGQGTLVTVSS

SEQ ID NO: 991 - protein, 109 aa, Artificial Sequence
  Synthetic
EIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKR

SEQ ID NO: 992 - protein, 10 aa, Artificial Sequence
  Synthetic
GFTFSSYAMS

SEQ ID NO: 993 - protein, 10 aa, Artificial Sequence
  Synthetic
AISGSGGSTY

SEQ ID NO: 994 - protein, 8 aa, Artificial Sequence
  Synthetic
GWLGNFDY

SEQ ID NO: 995 - protein, 12 aa, Artificial Sequence
  Synthetic
RASQSVSRSYLA

SEQ ID NO: 996 - protein, 7 aa, Artificial Sequence
  Synthetic
GASTRAT

SEQ ID NO: 997 - protein, 9 aa, Artificial Sequence
  Synthetic
QQGQVIPPT

SEQ ID NO: 998 - protein, 117 aa, Artificial Sequence
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGWFGGFNYWGQGTLVTVSS

SEQ ID NO: 999 - protein, 109 aa, Artificial Sequence
  Synthetic
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKR

SEQ ID NO: 1000 - protein, 10 aa, Artificial Sequence
  Synthetic
GFTFSSYAMS

SEQ ID NO: 1001 - protein, 10 aa, Artificial Sequence
  Synthetic
AISGSGGSTY

SEQ ID NO: 1002 - protein, 8 aa, Artificial Sequence
  Synthetic
GWFGGFNY

SEQ ID NO: 1003 - protein, 12 aa, Artificial Sequence
  Synthetic
RASQSVTSSYLA

SEQ ID NO: 1004 - protein, 7 aa, Artificial Sequence
  Synthetic
VGSRRAT

SEQ ID NO: 1005 - protein, 9 aa, Artificial Sequence
  Synthetic
QQGIMLPPT

SEQ ID NO: 1006 - protein, 116 aa, Artificial Sequence
  Synthetic
QVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSS

SEQ ID NO: 1007 - protein, 109 aa, Artificial Sequence; identical to SEQ ID NO: 991
  Synthetic

SEQ ID NO: 1008 - protein, 10 aa, Artificial Sequence
  Synthetic
GFTFSSHAMS

SEQ ID NO: 1009 - protein, 9 aa, Artificial Sequence
  Synthetic
AIWASGEQY

SEQ ID NO: 1010 - protein, 8 aa, Artificial Sequence
  Synthetic
GWLGNFDY

SEQ ID NO: 1011 - protein, 12 aa, Artificial Sequence
  Synthetic
RASQSVSRSYLA

SEQ ID NO: 1012 - protein, 7 aa, Artificial Sequence
  Synthetic
GASTRAT

SEQ ID NO: 1013 - protein, 9 aa, Artificial Sequence
  Synthetic
QQGQVIPPT

SEQ ID NO: 1014 - protein, 117 aa, Artificial Sequence
  Synthetic
EVQLLESGGGLVQPGGSLRLSCAASGFTFSSYAMSWVRQAPGKGLEWVSAIIGSGGITYYADSVKGRFTISRDNSKNTLYLQMNSLRAEDTAVYYCAKGWFGGFNYWGQGTLVTVSS

SEQ ID NO: 1015 - protein, 109 aa, Artificial Sequence; identical to SEQ ID NO: 999
  Synthetic

SEQ ID NO: 1016 - protein, 10 aa, Artificial Sequence
  Synthetic
GFTFSSYAMS

SEQ ID NO: 1017 - protein, 10 aa, Artificial Sequence
  Synthetic
AIIGSGGITY

SEQ ID NO: 1018 - protein, 8 aa, Artificial Sequence
  Synthetic
GWFGGFNY

SEQ ID NO: 1019 - protein, 12 aa, Artificial Sequence
  Synthetic
RASQSVTSSYLA

SEQ ID NO: 1020 - protein, 7 aa, Artificial Sequence
  Synthetic
VGSRRAT

SEQ ID NO: 1021 - protein, 9 aa, Artificial Sequence
  Synthetic
QQGIMLPPT

SEQ ID NO: 1022 - protein, 117 aa, Artificial Sequence
  Synthetic
EVQLLESGGGLVQPGGSLRLSCAASGFTFSSYAMSWVRQAPGKGLEWVSAILASGAITYYADSVKGRFTISRDNSKNTLYLQMNSLRAEDTAVYYCAKGWFGGFNYWGQGTLVTVSS

SEQ ID NO: 1023 - protein, 109 aa, Artificial Sequence; identical to SEQ ID NO: 999
  Synthetic

SEQ ID NO: 1024 - protein, 10 aa, Artificial Sequence
  Synthetic
GFTFSSYAMS

SEQ ID NO: 1025 - protein, 10 aa, Artificial Sequence
  Synthetic
AILASGAITY

SEQ ID NO: 1026 - protein, 8 aa, Artificial Sequence
  Synthetic
GWFGGFNY

SEQ ID NO: 1027 - protein, 12 aa, Artificial Sequence
  Synthetic
RASQSVTSSYLA

SEQ ID NO: 1028 - protein, 7 aa, Artificial Sequence
  Synthetic
VGSRRAT

SEQ ID NO: 1029 - protein, 9 aa, Artificial Sequence
  Synthetic
QQGIMLPPT

SEQ ID NO: 1030 - protein, 117 aa, Artificial Sequence
  Synthetic
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 1031 - protein, 109 aa, Artificial Sequence; identical to SEQ ID NO: 999
  Synthetic

SEQ ID NO: 1032 - protein, 10 aa, Artificial Sequence
  Synthetic
GFTFSSYAMS

SEQ ID NO: 1033 - protein, 10 aa, Artificial Sequence
  Synthetic
AIIGSGASTY

SEQ ID NO: 1034 - protein, 8 aa, Artificial Sequence
  Synthetic
GWFGGFNY

SEQ ID NO: 1035 - protein, 12 aa, Artificial Sequence
  Synthetic
RASQSVTSSYLA

SEQ ID NO: 1036 - protein, 7 aa, Artificial Sequence
  Synthetic
VGSRRAT

SEQ ID NO: 1037 - protein, 9 aa, Artificial Sequence
  Synthetic
QQGIMLPPT

SEQ ID NO: 1038 - protein, 407 aa, Artificial Sequence
  Synthetic
QVQLQESGGGLVQPGGSLRLSCAASGSTFSINAVAWYRQAPGKRRELVAGISGGGVTNYPDSVKGRFTISRDNAKNTVYLQMSSLKPEDTAVYYCNLWPPRASPGGRVYWGQGTQVTVSSGGSGGSGGSGGSGGSGGSGGSGGSGGSGGSGGSGGSGGSGGSGGSGGSGGSGGSGGSGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCQVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1039 - protein, 406 aa, Artificial Sequence
  Synthetic
QVQLQESGGGLVQPGGSLRLSCAASGSTFSGNAMAWYRQAPGKRRELVAGISGGGVTNYPDSVKGRFTISRDNAKNTVYLQMSSLKPEDTAVYYCNLWPPRVSPGGGVYWGQGTQVTVSSGGSGGSGGSGGSGGSGGSGGSGGSGGSGGSGGSGGSGGSGSGGSGGSGGSGGSGGSGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCQVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1040 - protein, 407 aa, Artificial Sequence
  Synthetic
QVQLQESGGGLVQPGESLRLSCAVSGSTSSMNAMAWYRQAPGKRRELVAGISGGGATNYPDSVKGRFTISRDNAKNTVYLQMSSLKPEDTAVYYCNLWPPRASPGGGVYWGQGTQVTVSSGGSGGSGGSGGSGGSGGSGGSGGSGGSGGSGGSGGSGGSGGSGGSGGSGGSGGSGGSGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCQVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1041 - protein, 452 aa, Artificial Sequence
  Synthetic
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCQVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKGGSGGSGGSGGSGGSGGSGGSGGSGGSGGSGGSGGSGGSGGSGGSGGSGGSGGSGGSGGSCDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVEETPLMKEDSILAVRKYFQRITLYLKEKKYSPCAWEVVRAEIMASFSLSTNLQESLRSKE

SEQ ID NO: 1042 - protein, 46 aa, Artificial Sequence
  Synthetic
KKYFRRITLYLTEKKYSPCAWEVVRAEIMRSLSLSTNLQERLRRKE

SEQ ID NO: 1043 - protein, 166 aa, Artificial Sequence
  Synthetic
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 1044 - protein, 114 aa, Artificial Sequence
  Synthetic
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1045 - protein, 120 aa, Artificial Sequence; identical to SEQ ID NO: 6
  Synthetic Sequence

SEQ ID NO: 1046 - protein, 120 aa, Artificial Sequence
  Synthetic Sequence
DVQLVESGGGLVQPGGSLRLSCAASGSTFSINAVAWYRQAPGKRRELVAGISGGGVTNYPDSVKGRFTISRDNSKNTVYLQMSSLRPEDTAVYYCNLWPPRASPGGRVYWGQGTLVTVSS

SEQ ID NO: 1047 - protein, 120 aa, Artificial Sequence
  Synthetic Sequence
DVQLVESGGGLVQPGGSLRLSCAASGSTFSINAVAWYRQAPGKRRELVAGISGGGVTNYADSVKGRFTISRDNSKNTVYLQMSSLRPEDTAVYYCNLWPPRASPGGRVYWGQGTLVTVSS

SEQ ID NO: 1048 - protein, 120 aa, Artificial Sequence
  Synthetic Sequence
DVQLVESGGGLVQPGGSLRLSCAASGSTFSINAVAWYRQAPGKRRELVAGISGGGVTNYPDSVKGRFTISRDNSKNTVYLQMNSLRPEDTAVYYCNLWPPRASPGGRVYWGQGTLVTVSS

SEQ ID NO: 1049 - protein, 120 aa, Artificial Sequence
  Synthetic Sequence
DVQLVESGGGLVQPGGSLRLSCAASGSTFSINAVAWYRQAPGKRRELVAGISGGGVTNYADSVKGRFTISRDNSKNTVYLQMNSLRPEDTAVYYCNLWPPRASPGGRVYWGQGTLVTVSS

SEQ ID NO: 1050 - protein, 120 aa, Artificial Sequence
  Synthetic Sequence
QVQLQESGGGLVQPGGSLRLSCAASGSTFSIAAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1051 - protein, 120 aa, Artificial Sequence
  Synthetic Sequence
QVQLQESGGGLVQPGGSLRLSCAASGSTFSIDAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1052 - protein, 120 aa, Artificial Sequence
  Synthetic Sequence
QVQLQESGGGLVQPGGSLRLSCAASGSTFSIEAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1053 - protein, 120 aa, Artificial Sequence
  Synthetic Sequence
QVQLQESGGGLVQPGGSLRLSCAASGSTFSIFAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1054 - protein, 120 aa, Artificial Sequence
  Synthetic Sequence
QVQLQESGGGLVQPGGSLRLSCAASGSTFSIGAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1055 - protein, 120 aa, Artificial Sequence
  Synthetic Sequence
QVQLQESGGGLVQPGGSLRLSCAASGSTFSIHAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1056 - protein, 120 aa, Artificial Sequence
  Synthetic Sequence
QVQLQESGGGLVQPGGSLRLSCAASGSTFSIIAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1057 - protein, 120 aa, Artificial Sequence
  Synthetic Sequence
QVQLQESGGGLVQPGGSLRLSCAASGSTFSIKAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1058 - protein, 120 aa, Artificial Sequence
  Synthetic Sequence
QVQLQESGGGLVQPGGSLRLSCAASGSTFSILAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1059 - protein, 120 aa, Artificial Sequence
  Synthetic Sequence
QVQLQESGGGLVQPGGSLRLSCAASGSTFSIPAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1060 - protein, 120 aa, Artificial Sequence
  Synthetic Sequence
QVQLQESGGGLVQPGGSLRLSCAASGSTFSIQAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1061 - protein, 120 aa, Artificial Sequence
  Synthetic Sequence
QVQLQESGGGLVQPGGSLRLSCAASGSTFSIRAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1062 - protein, 120 aa, Artificial Sequence
  Synthetic Sequence
QVQLQESGGGLVQPGGSLRLSCAASGSTFSISAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1063 - protein, 120 aa, Artificial Sequence
  Synthetic Sequence
QVQLQESGGGLVQPGGSLRLSCAASGSTFSITAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1064 - protein, 120 aa, Artificial Sequence
  Synthetic Sequence
QVQLQESGGGLVQPGGSLRLSCAASGSTFSIVAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1065 - protein, 120 aa, Artificial Sequence
  Synthetic Sequence
QVQLQESGGGLVQPGGSLRLSCAASGSTFSIWAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1066 - protein, 120 aa, Artificial Sequence
  Synthetic Sequence
QVQLQESGGGLVQPGGSLRLSCAASGSTFSIYAVAWYRQAPGKRRELVAGISGGGVTNYPDSVKGRFTISRDNAKNTVYLQMSSLKPEDTAVYYCNLWPPRASPGGRVYWGQGTQVTVSS

SEQ ID NO: 1067 - protein, 120 aa, Artificial Sequence; identical to SEQ ID NO: 55
  Synthetic Sequence

SEQ ID NO: 1068 - protein, 120 aa, Artificial Sequence
  Synthetic Sequence
QVQLQESGGGLVQPGESLRLSCAVSGSTSSANAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1069 - protein, 120 aa, Artificial Sequence
  Synthetic Sequence
QVQLQESGGGLVQPGESLRLSCAVSGSTSSDNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1070 - protein, 120 aa, Artificial Sequence
  Synthetic Sequence
QVQLQESGGGLVQPGESLRLSCAVSGSTSSENAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1071 - protein, 120 aa, Artificial Sequence
  Synthetic Sequence
QVQLQESGGGLVQPGESLRLSCAVSGSTSSFNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1072 - protein, 120 aa, Artificial Sequence
  Synthetic Sequence
QVQLQESGGGLVQPGESLRLSCAVSGSTSSGNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1073 - protein, 120 aa, Artificial Sequence
  Synthetic Sequence
QVQLQESGGGLVQPGESLRLSCAVSGSTSSHNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1074 - protein, 120 aa, Artificial Sequence
  Synthetic Sequence
QVQLQESGGGLVQPGESLRLSCAVSGSTSSINAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1075 - protein, 120 aa, Artificial Sequence
  Synthetic Sequence
QVQLQESGGGLVQPGESLRLSCAVSGSTSSKNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1076 - protein, 120 aa, Artificial Sequence
  Synthetic Sequence
QVQLQESGGGLVQPGESLRLSCAVSGSTSSLNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1077 - protein, 120 aa, Artificial Sequence
  Synthetic Sequence
QVQLQESGGGLVQPGESLRLSCAVSGSTSSNNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1078 - protein, 120 aa, Artificial Sequence
  Synthetic Sequence
QVQLQESGGGLVQPGESLRLSCAVSGSTSSPNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1079 - protein, 120 aa, Artificial Sequence
  Synthetic Sequence
QVQLQESGGGLVQPGESLRLSCAVSGSTSSQNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1080 - protein, 120 aa, Artificial Sequence
  Synthetic Sequence
QVQLQESGGGLVQPGESLRLSCAVSGSTSSRNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1081 - protein, 120 aa, Artificial Sequence
  Synthetic Sequence
QVQLQESGGGLVQPGESLRLSCAVSGSTSSSNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1082 - protein, 120 aa, Artificial Sequence
  Synthetic Sequence
QVQLQESGGGLVQPGESLRLSCAVSGSTSSTNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1083 - protein, 120 aa, Artificial Sequence
  Synthetic Sequence
QVQLQESGGGLVQPGESLRLSCAVSGSTSSVNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1084 - protein, 120 aa, Artificial Sequence
  Synthetic Sequence
QVQLQESGGGLVQPGESLRLSCAVSGSTSSWNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1085 - protein, 120 aa, Artificial Sequence
  Synthetic Sequence
QVQLQESGGGLVQPGESLRLSCAVSGSTSSYNAMAWYRQAPGKRRELVAGISGGGATNYPDSVKGRFTISRDNAKNTVYLQMSSLKPEDTAVYYCNLWPPRASPGGGVYWGQGTQVTVSS

SEQ ID NO: 1086 - protein, 120 aa, Artificial Sequence
  Synthetic Sequence
DVQLVESGGGLVQPGGSLRLSCAASGSTFSIWAVAWYRQAPGKRRELVAGISGGGVTNYPDSVKGRFTISRDNSKNTVYLQMSSLRPEDTAVYYCNLWPPRASPGGRVYWGQGTLVTVSS

SEQ ID NO: 1087 - protein, 120 aa, Artificial Sequence
  Synthetic Sequence
DVQLVESGGGLVQPGGSLRLSCAASGSTFSIWAVAWYRQAPGKRRELVAGISGGGVTNYPDSVKGRFTISRDNSKNTVYLQMNSLRPEDTAVYYCNLWPPRASPGGRVYWGQGTLVTVSS

SEQ ID NO: 1088 - protein, 120 aa, Artificial Sequence; identical to SEQ ID NO: 55
  Synthetic Sequence

SEQ ID NO: 1089 - protein, 120 aa, Artificial Sequence
  Synthetic Sequence
DVQLVESGGGLVQPGGSLRLSCAASGSTSSAWAMAWYRQAPGKRRELVAGISGGGATNYPDSVKGRFTISRDNSKNTVYLQMSSLRPEDTAVYYCNLWPPRASPGGGVYWGQGTLVTVSS

SEQ ID NO: 1090 - protein, 120 aa, Artificial Sequence
  Synthetic Sequence
DVQLVESGGGLVQPGGSLRLSCAASGSTSSDWAMAWYRQAPGKRRELVAGISGGGATNYPDSVKGRFTISRDNSKNTVYLQMSSLRPEDTAVYYCNLWPPRASPGGGVYWGQGTLVTVSS

SEQ ID NO: 1091 - protein, 120 aa, Artificial Sequence
  Synthetic Sequence
DVQLVESGGGLVQPGGSLRLSCAASGSTSSAWAMAWYRQAPGKRRELVAGISGGGATNYPDSVKGRFTISRDNSKNTVYLQMNSLRPEDTAVYYCNLWPPRASPGGGVYWGQGTLVTVSS

SEQ ID NO: 1092 - protein, 120 aa, Artificial Sequence
  Synthetic Sequence
DVQLVESGGGLVQPGGSLRLSCAASGSTSSDWAMAWYRQAPGKRRELVAGISGGGATNYPDSVKGRFTISRDNSKNTVYLQMNSLRPEDTAVYYCNLWPPRASPGGGVYWGQGTLVTVSS

SEQ ID NO: 1093 - protein, 10 aa, Artificial Sequence
  Synthetic Sequence
GSTFSIAAVA

SEQ ID NO: 1094 - protein, 10 aa, Artificial Sequence
  Synthetic Sequence
GSTFSIDAVA

SEQ ID NO: 1095 - protein, 10 aa, Artificial Sequence
  Synthetic Sequence
GSTFSIEAVA

SEQ ID NO: 1096 - protein, 10 aa, Artificial Sequence
  Synthetic Sequence
GSTFSIFAVA

SEQ ID NO: 1097 - protein, 10 aa, Artificial Sequence
  Synthetic Sequence
GSTFSIGAVA

SEQ ID NO: 1098 - protein, 10 aa, Artificial Sequence
  Synthetic Sequence
GSTFSIHAVA

SEQ ID NO: 1099 - protein, 10 aa, Artificial Sequence
  Synthetic Sequence
GSTFSIIAVA

SEQ ID NO: 1100 - protein, 10 aa, Artificial Sequence
  Synthetic Sequence
GSTFSIKAVA

SEQ ID NO: 1101 - protein, 10 aa, Artificial Sequence
  Synthetic Sequence
GSTFSILAVA

SEQ ID NO: 1102 - protein, 10 aa, Artificial Sequence
  Synthetic Sequence
GSTFSIPAVA

SEQ ID NO: 1103 - protein, 10 aa, Artificial Sequence
  Synthetic Sequence
GSTFSIQAVA

SEQ ID NO: 1104 - protein, 10 aa, Artificial Sequence
  Synthetic Sequence
GSTFSIRAVA

SEQ ID NO: 1105 - protein, 10 aa, Artificial Sequence
  Synthetic Sequence
GSTFSISAVA

SEQ ID NO: 1106 - protein, 10 aa, Artificial Sequence
  Synthetic Sequence
GSTFSITAVA

SEQ ID NO: 1107 - protein, 10 aa, Artificial Sequence
  Synthetic Sequence
GSTFSIVAVA

SEQ ID NO: 1108 - protein, 10 aa, Artificial Sequence
  Synthetic Sequence
GSTFSIWAVA

SEQ ID NO: 1109 - protein, 10 aa, Artificial Sequence
  Synthetic Sequence
GSTFSIYAVA

SEQ ID NO: 1110 - protein, 10 aa, Artificial Sequence
  Synthetic Sequence
GSTSSANAMA

SEQ ID NO: 1111 - protein, 10 aa, Artificial Sequence
  Synthetic Sequence
GSTSSDNAMA

SEQ ID NO: 1112 - protein, 10 aa, Artificial Sequence
  Synthetic Sequence
GSTSSENAMA

SEQ ID NO: 1113 - protein, 10 aa, Artificial Sequence
  Synthetic Sequence
GSTSSFNAMA

SEQ ID NO: 1114 - protein, 10 aa, Artificial Sequence
  Synthetic Sequence
GSTSSGNAMA

SEQ ID NO: 1115 - protein, 10 aa, Artificial Sequence
  Synthetic Sequence
GSTSSHNAMA

SEQ ID NO: 1116 - protein, 10 aa, Artificial Sequence
  Synthetic Sequence
GSTSSINAMA

SEQ ID NO: 1117 - protein, 10 aa, Artificial Sequence
  Synthetic Sequence
GSTSSKNAMA

SEQ ID NO: 1118 - protein, 10 aa, Artificial Sequence
  Synthetic Sequence
GSTSSLNAMA

SEQ ID NO: 1119 - protein, 10 aa, Artificial Sequence
  Synthetic Sequence
GSTSSNNAMA

SEQ ID NO: 1120 - protein, 10 aa, Artificial Sequence
  Synthetic Sequence
GSTSSPNAMA

SEQ ID NO: 1121 - protein, 10 aa, Artificial Sequence
  Synthetic Sequence
GSTSSQNAMA

SEQ ID NO: 1122 - protein, 10 aa, Artificial Sequence
  Synthetic Sequence
GSTSSRNAMA

SEQ ID NO: 1123 - protein, 10 aa, Artificial Sequence
  Synthetic Sequence
GSTSSSNAMA

SEQ ID NO: 1124 - protein, 10 aa, Artificial Sequence
  Synthetic Sequence
GSTSSTNAMA

SEQ ID NO: 1125 - protein, 10 aa, Artificial Sequence
  Synthetic Sequence
GSTSSVNAMA

SEQ ID NO: 1126 - protein, 10 aa, Artificial Sequence
  Synthetic Sequence
GSTSSWNAMA

SEQ ID NO: 1127 - protein, 10 aa, Artificial Sequence
  Synthetic Sequence
GSTSSYNAMA

SEQ ID NO: 1128 - protein, 10 aa, Artificial Sequence
  Synthetic Sequence
GSTSSAWAMA

SEQ ID NO: 1129 - protein, 10 aa, Artificial Sequence
  Synthetic Sequence
GSTSSDWAMA

What is claimed is:

1. A fibroblast activation protein (FAP) binding agent comprising a targeting moiety comprising a recombinant heavy chain only antibody (VHH) or a humanized VHH, wherein the targeting moiety comprises three complementarity determining regions (CDR1, CDR2, and CDR3), wherein (a) CDR1 comprises the amino acid sequence of SEQ ID NO: 1108, 1096, 1103, 1104, or 111; CDR2 comprises the amino acid sequence of SEQ ID NO: 128; and CDR3 comprises the amino acid sequence of SEQ ID NO: 159;

(b) CDR1 comprises the amino acid sequence of SEQ ID NO: 1128, 1129, 1110, 1111, 1117, 1118, 1119, 1121, 1122, 1123, 1126, or 855; CDR2 comprises the amino acid sequence of SEQ ID NO: 126; and CDR3 comprises the amino acid sequence of SEQ ID NO: 157;

(c) CDR1 comprises the amino sequence of SEQ ID NO: 111; CDR2 comprises the amino acid sequence of SEQ ID NO: 128; and CDR3 comprises the amino acid sequence of SEQ ID NO: 156;

(d) CDR1 comprises the amino sequence of SEQ ID NO: 89; CDR2 comprises the amino acid sequence of SEQ ID NO: 128; and CDR3 comprises the amino acid sequence of SEQ ID NO: 159;

(e) CDR1 comprises the amino sequence of SEQ ID NO: 111; CDR2 comprises the amino acid sequence of SEQ ID NO: 129; and CDR3 comprises the amino acid sequence of SEQ ID NO: 156;

(f) CDR1 comprises the amino sequence of SEQ ID NO: 115; CDR2 comprises the amino acid sequence of SEQ ID NO: 128; and CDR3 comprises the amino acid sequence of SEQ ID NO: 159;

(g) CDR 1 comprises the amino sequence of SEQ ID NO: 107; CDR2 comprises the amino acid sequence of SEQ ID NO: 128; and CDR3 comprises the amino acid sequence of SEQ ID NO: 169;

(h) CDR 1 comprises the amino sequence of SEQ ID NO: 115; CDR2 comprises the amino acid sequence of SEQ ID NO: 128; and CDR3 comprises the amino acid sequence of SEQ ID NO: 156;

(i) CDR1 comprises the amino sequence of SEQ ID NO: 855; CDR2 comprises the amino acid sequence of SEQ ID NO: 125; and CDR3 comprises the amino acid sequence of SEQ ID NO: 157; or (j) CDR1 comprises the amino sequence of SEQ ID NO: 97; CDR2 comprises the amino acid sequence of SEQ ID NO: 119; and CDR3 comprises the amino acid sequence of SEQ ID NO: 159.

2. The FAP binding agent of claim 1, wherein the FAP binding agent comprises an amino acid sequence having at least 90% sequence similarity with:

(a) any one of SEQ ID NO: 1087, 1092, 1086, 1088-1091;

(b) any one of SEQ ID NO: 2 to 42;

(c) any one of SEQ ID NO: 46 to 86;

(d) any one of SEQ ID NO: 837-850; or (e) any one of SEQ ID NO: 1045-1085.

3. The FAP binding agent of claim 1, wherein the FAP binding agent comprises one or more signaling agents.

4. The FAP binding agent of claim 3, wherein the signaling agent is an interferon, an interleukin, a tumor necrosis factor, or a mutated form thereof.

5. The FAP binding agent of claim 4, wherein the targeting moiety and the signaling agent are connected with one or more linkers.

6. The FAP binding agent of claim 4, wherein the signaling agent is a mutated interferon alpha 2 (IFNα2) comprising an amino acid sequence having at least 95% identity with SEQ ID NO: 176 or an amino acid sequence having at least 95% identity with SEQ ID NO: 177.

7. The FAP binding agent of claim 6, wherein the IFNα2 has:

(a) one or more mutations at positions 144 to 154 with respect to SEQ ID NO: 176 or 177; or (b) one or more mutations at positions L15, A19, R22, L26, F27, L30, K31, D32, R33, H34, D35, Q40, H57, E58, Q61, F64, N65, T69, L80, Y85, Y89, T106, D114, L117, R120, R125, K133, K134, R144, A145, M148, R149, S152, L153, and N156 with respect to SEQ ID NO: 176 or 177.

8. The FAP binding agent of claim 6, wherein the mutated IFNα2 has one or more mutations at position R149, M148, or L153 with respect to SEQ ID NO: 176 or 177.

9. The FAP binding agent of claim 3, wherein the signaling agent is a mutated interferon-β (IFN-β) comprising an amino acid sequence having at least 95% identity with SEQ ID NO: 178.

10. The FAP binding agent of claim 9, wherein the mutated human IFN-β comprises one or more mutations at positions W22, R27, L32, R35, V148, L151, R152, and Y155 with respect to SEQ ID NO: 178.

11. The FAP binding agent of claim 3, wherein the signaling agent is a mutated tumor necrosis factor α (TNFα) comprising an amino acid sequence having at least 95% identity with SEQ ID NO: 182.

12. The FAP binding agent of claim 11, wherein the mutated TNFα has one or more mutations at a position selected from L29, R31, R32, A84, V85, S86, Y87, Q88, T89, I97, Y115, A145, E146 and S147 with respect to SEQ ID NO: 182.

13. The FAP binding agent of claim 1, wherein the FAP binding agent comprises one or more additional targeting moieties.

14. The FAP binding agent of claim 13, wherein the one or more additional targeting moieties recognize an antigen on a tumor cell or an antigen on an immune cell.

15. The FAP binding agent of claim 14, wherein the one or more additional targeting moieties recognize Programmed Death 1 (PD-1), Programmed death-ligand 1 (PD-L1), Programmed death-ligand 2 (PD-L2), cytotoxic T-lymphocyte antigen 4 (CTLA4), Tumor Necrosis Factor Superfamily Member 4 ligand (OX40L), Tumor Necrosis Factor Superfamily Member 4 (OX40), Cluster of Differentiation 20 (CD20), X-C motif chemokine receptor 1 (XCR1), Fms-like tyrosine kinase 3 (Flt3), or C-type lectin domain family 9 member A (Clec9A).

16. A recombinant nucleic acid encoding the FAP binding agent of claim 1.

17. An isolated host cell comprising the nucleic acid of claim 16.

\*    \*    \*    \*    \*